United States Patent 10,233,495 (METHODS AND COMPOSITIONS FOR SCREENING AND TREATING DEVELOPMENTAL DISORDERS) - sequence listing, part 42

SEQ ID NO: 489 - DNA, 868005 bp, Homo sapiens
ggacacaacaaaggcccgtgtttatgagggggacagtaacaatacatacgtgaattctccaaactgtgtttgcgaggggaacagaataacaatacataacgtgaattctccaaactgtgtttgtgagggggacagagtaacaatacatacttgaattctgcaaactgtgtttgccaggggaacagaataacaatacacacgtgaattctccaaactgtgtttgccaggggaacagaataacaatacacacgtgaattctccaaactgtgtttgccaggggaacagtaacaatacacacctgaattctcgaaactgtgtttgtaagggggacagagtaacaatacacacatgaattctccaaatgccagaaggtggtcagtgctctgacaaaacaagtgggaggagggtgggagcccaggagggcgggagggtcaggtggttatccagggggatggtgaagccaagacatgaaggaagggaaggcggtggccgagcaggtctgagtaggcggaggaccagcgagttctgatccaattgttgaggtccctgatctcaccctctgggcattcaggaccttaggtgctgctgcgagttcagggcagagggaagttggagcatggaaggtctgggaatcttgtgagcgccccaagtgtgcacctggtatgggccgaccaagtcagagggatcaagaacttaagtaaatggaaagagtgtgtcatgacaccttagtgagaatttatatctcgtggggagccccgcctgtgggccagctaagcaccttctgtgcagtgggcctttccagacccttgcaggaagatggggccggcctggtgggctggggtgcctgggtgaggcctcttcagtgggccctgaccctgcagccaggcagctcctggtggctgtcccaaacaggcctcaccccttctccttggatgtgtccttccaggtcaccttttctataaatttggcatcacagaatctgactggtaccgaatcaagcagagcatcgactccaagtgccgcacggcgtggcggcgcaagcagtggggccagagcctggtggtcaagagcttctcgtggagaatgcccaactcatcctcctactgcccctcaggtaggcctcgtgctgcaggagaggccgccctcccctgctcggggcagctggcctggtggcaccctcaggggcagccagagcgtggccggcggctccaccaatggccgggagccgaggccagaggcttgtgaggtgcacacggagcagtggagctgcaggacctgtgcctggccctgtgcgcccttcacacagacagcctcgggcctgctccaggctcctctgtgagggacagagggcctgttgggcctcctggaagtcttctggatgggggcaaggaggccgaggcctttgtgtagggctgccggccattgtattctcacgatttgcctggtgactccgggtgaggaagtggggtggattctgaattgtgctttatttttactttgagttcatggccttagttggatttatccacaagataatggaaacagttctctttgagttgcctctcaggcattgctggggagattgttctccttggagaattttcactaggaatgacaatgtgacttgatactgccttttacccaagacatctcaaaatattttaatacgtatttgaatgaaaactattctcttaaagctccccacagtagctgcattggcagtgactcttggaacttgagctctgactggggctggggtcaggatgcgagggcagctgtgggcagggccagctctcctattcagtggagtctttgtcggccggaaccctttgttctggaagtcctgggagttacagaccagatcacctggagttctcccggggcctcgttctttctgaaccggacttcaggaagtggttttcccgggctgttttggtagttatcagatactcggcctcagctgctgcccaggggcttgaggatgggaggtggctgcctgtagtgggccacacaagttgtgtccctaaagcagcactttattgagtgacctgtgttgaagaagctcttctattctaggcctttctactacaatgaggaattctgccttgggacttgagagaggtagcagtcctagggtgtgggttaggggcattcactgaaataccatgtagcagcgtaacctgtggctattgaaatgtggctgtaggaatattgctcatgacttgacttctctcttgaatattcatagctgggcagcagagagcgatgtgaggactatacttatggcatgataccatttttattgcaaatatataggtatatgtggaagttgattaaaaatttatgtgtgatcatttttacagtgcctatctctaggtagtaggataatttttatttttccctttgtcttttattgtagtttctcagttatttccaataagcactgcattagttttatagttgtaaaaaatgttgtttaaaagtcagggagcccaggcgtggtggctcatgcctgtaatcccagcactttgggaggctgaggcaaactgatcacctgaggtcagcagttcgagatcagcctggacaacatggtgaaaccctgtctctactaaaaatacaaaaattagccaggtgtggtggcacatgcctctaatcccagctactcgggaggctgaggcaggagaatggcgtgaacctgggaggcggagcttacagtgagccgagatcacgccactgcactccagcctgggctacagagcaagactctgtctcaaaaaaaaaaaaaaaaaaaagtcaaggagaggagatttctgtcaggcacaatttctgtcaggcacaatttctgtcaggcacagtagcaggaaccagattgaattctcttgccattgaaatctggacaaaaatctgtgaatcggctgtcctaagacattagacaagcaacagcacaggaccgtgatcccgagagaaggaacacgagaggaggggacagggagatgccaggcagagatagctacatcactgcatggaggagatgggttggagttgagagaggctgaggcagcagaaagttgtggaatcaagttcttaagagcagagggttacacgggggccatcttgggtgtttgggggattccaaggcaggcatgagctcaatggctcctaagctcaccccaggctgggtggtggttggattcccactagccagagtcctcagtgatcagtcactgcactagctggccatgcctactggcaggctaaactgtccctagaataaaggcagagcttaagagagcctgagaaagatcacattgaatcacaagtaacaacacttttaaaagaaagacaacaaaacctagacacccaacaaagtaaaattcacaatctccagtatctagtccagagtaccaggaagcaggagattgtgacctatgatcagaaaatcagcaaataggaagggaccctgtctggaattaactgaccaggacattgaaatctattaaaattacattcaggaatttaaaggaaaaaaggaacatagcaaggagcgaaatagaagacataaaaaagaaccatatggaactcctagactcgaagagcgaggagagttgttgccaggcttgccttccatgtgtttcgggtacgtgcatttggtaaggttagcggtctgcttcatccaatggggaatcaaaacccaagttaaatgacttgccaggaccttagtgagcaagaagctgctgttatataacctgacgactgccagatatgttggcctgcatcattaggataccagaatcttgaaagggtaaatttagtgagctgaaatttcatagctggaaatgtagactaagagcatttgcacagtagtagacggtggtgtaacagcatgtgaagctgagtgttttgctggctgcgctggtgtgcaggagcttcctcagagcccttgtggttggaaggtgcactctggagcacacccattcttagcttgtctaccctgtggccccagtggagcgttttggagctgctgggaggagctgtccagggacagactgtcatggtggcagtgggctggaaacttgtctttggggaaacggttagaaattgagatttcacaaggtttgataacggttagatgcctggagaagcagtgcataagtgaagaattaggctggttttgtaggtgctaagagggtcagtggaggaaaagcagctccgcggaggtgggcttcagcccagctgggattttgtcattttcttcctggggtgcacaaggcttgctcgaggacctgtggtggtgagtgctctgtaactgctcaggcagacaggaaaccgccatggagcacgcagcactgcctggcggtggttgctttgggacatgacccatcactggaggtgctcaggtggagtcagggtctttggctggagccaagctctccacgtgcagcatgcaggtgggcatgttgaatctcctttgaatctcatgaatttcagattctgatttagtgtagctaggcaatttctagcatattgcaagtatcaacattctgttatgtggctgggcacagtggcttacacctataatcccagcattttgggaggccaaggcaggcggatcatttgaggtcaggagttcaaaaccagcctggccaacctggtgaaatcccttctctacaaaaaaatacaaaaaaaagattagcccagcatgatggtgggtgcctgttatcccagctacttggaaggctgaggcaggagaatcgcttgaacttgggaggcggaagttgcagtgagccaaggtcacaccactacactccagcctgggtgacagagcaagactctgtctcaaaaaaaaaaaaaaaaaccaacattttattgttactttaaaaaatgtattcagtggaatctatgtactatggcaatttaatacctaccattagctattggtaaaaaatacatggaaagcttttctctccccttcccctctctgcccctccccctccccctctccgcccctcccccttccctccctcctcccctctcccctcctcccttcctctctcttgccctcccctctcttgccccaacccgtcccttcccctgctcgctctgttgcctggagctaagtgccatggtgccatctcagctcactgtaatcacctactcccaggttcaagtgattctcctacttcagcctcccaagtagttgtgactacagatgcatgccgccacacctggctaatttttgtatttttagtagagacagggttcaccatgttggtcaggctggtctcgaactcctgacctgaagtgatcttgcctgccttggcctcccaaaatactgggattacaagcgtgagccaccatgcctggcctgcttctctttaataatcagaaattttatgtctttcatttttctcctttcattcatatcaacattctacttctctcacagaatttcatctttctgcttccctccccagtccccccgagatggagtcttgctctgttgcccaggctggagtgtagtggtgccattttgactcattacaacctccgcctcccaggtttaagtgattctcctgcctcagcctcctgagtgcctgggattacagacccccaccaccacgcctgtctaatttttgtatttttaatagagatggggtttcaccatgttggccaggctggtcttgaactcgtgacctcaggtgatctggctgccttggcctcacaaagtgctgggattacaggtgtgagccaccgtgcccagactacatttttacgcttaaaagctttttaaaattagtcattataattctctgcaacaaaactacgtgtatacattgaaaattaaagtttttctgcgctcttaatattctaagagtttaagaaaattatgattgagacatcattacagtgaaaattaatacacagtacatcaaagcaaatgtatctcattttgattaaacacagcaagtaaaatttgttggaaatgtatctttaagtgcgtggatgagacttttgctctattagtttaattacccatggacaaatattgccagcctgaaacagcttttaatgtccactttaagaacttcattcatttaaataagttggggactagaaggggttttgtcatagcatcacgccactctcaggcccttctgcattccacgtcggaaaactcagttcctaagactcactcatagtgacctctgcagaagagtggagatgcagtgagtcgaggaaaaatgaagcatttcctcttctctgctgtgggagtcgagagtgagggacgggggtgcacacatgctgcacaaggcaatgcctaagaaacttctcgttcaccccgttcacacctgtttcctccacagagccgatgatgagcaccccacctcctgccagagagctcctgcagccacagctgcagccgcaggccctgcactacgcgctggccaacgtgcagcaggtgcagatccaccagatcggagaagacggacaggtgcaagtagtacgtaccctctccacctcgcaccttggtaaagggggctgtggggtgggccacggcggggccatggcggcttccaccagttccgctgtgtttcgggagcacagtgatagcttgggaggaggcacaaggttcccatttaaagtagaggtcatcgtggccatgagctcttaacatttcacaggtgggggcggctgctgcagagcctagggattgaagcacatggtggggtggggcattcagtcagctcacctcagtcctgccagcaggcaggcgggcagtcagctccaagggtcaggccgtgcagtggtccctgccccagctcgtgctcctgggaagcaacggaaatatttctcagctcagaagtgcaggcgtcctcttactgagggaaagagtaatttccttctaggatcagtggcaaaagcttgaggtcattgttcccatgcagcgtttcccttggagttactcagcacacccaggttgggcgggcactgtcccagcagcaagtcaatgtcctgccttgcccgtgcggagttctctgttggggttttgtgacccaagctgtggtcagtctgatgcgcctaggggctcgctcccgggtgaagtccctctacaaacacctcctggattctgtggcacgagagtagggggcggctgagaagaagacttttctggaagctttgctgagtgactagaaattttacatgtaccactagacctagcctgtgtttttagtggcaccagcccccttgggccctctgaagacaggtcatcgtgtgcctccgtgttaccagggctttctcctggaaacaaggtcctccactattgagagtgggtcgtggctctcatgtcagtgtggcttcagcgtgctgtctggaagagggaaggcttccagaaaattctggggcttttagagggggcattcccttcctcttccaaaggagatgagacagttatgaatagtgaatcttatttaataagcttattaatttgtttgacattcacaatggcagttcctctcatcttgttagtaagaagttctttgaaagcgttccagagtagataactttgtcataaggcttacatagaactttctacaggagtttaagatccatttcaactaagagagaatttcaaataagataaggagtattcatttcatttacaggtttataggaaatatttgtctgcccgtatgtataaacagtggattctttgattttttttgaatcacatttgttagtgtttcctcaaactgtttaaatagtcatatgagtgtttctttgatttgaaaaacgttgcctgccctgttgtgagtgtaggcacgcaaacagctcccctgcttcagccacacactgcttgtgtagcctcccagcatccccagagagctgaacgtatcatttgaaaagaggcgtcattgtgattttctatttcccctcttttctgtgtgtcatgcacattttaaaatttacttgtttagtaacatttaaagatgtatatatctttcctgggacctattgctcctttgtgaagtactggaacatgttctgtgttacacagtacccccccttacccatgcttccactttcctaggttttaattacccacagtcaactgtgatctgaaaatattagatgagaaattccagaaataaacaatttgtaagtttcagattgcatactcttctgggtagtaccatgatgaagtctggtcgtcctgctgtgtccagcccgggatgtgagtcattcctttgtccagcatgtccaagctgtgtggcacgtatgggcaggaaaaagcatagcatatacggggttcagcaccatccacggtttctgacgtccacatggtggggggagggggcgcttcttgaaaccctcatggatgagggggactactgtgaaccaaaagcttaatttaaagaggtgaccacagactatattgcactattcaggatttagttatctttttgaattgtaaacagataatcaagaacaaacattccggaagatgtttcttgtttcctttgctttttattttcttctgatgcttcttggtgtcttttcttactgcggatcccacagggacacctccacatcgccaaggtgccacagggggagcaagtccagatcacgcaggacagcgaggtgagtcatctctcgctgcagccctgtccctgcaggcactgtgcccgcatgctcccgaccttcatcagtgtcacagtgtgagggcagcagggagcccccaggatggggaacgtgggcgagggctgcaggactccgcttccagggtgcacatagtgggcctgcagtctctgtggcctcactgcctccccctcctgtccgttggtctccacagcttctggtctgtcttggcaaagatctcctgggtagatgtttctgctcctggctggaagtgccctctgagtacccttctctccctgtctggccctgcccttcctgccaggggagggccccagtgtggccgagatggggtctgcccctgcacaggtgacctgacataccccctcacctgccatgtggccccagcttcctggtggcctctacaggattagtgccgatttcataggatggtggggaatcccacaaggtgatgctgccagtcctgagagctggtcatagccctgacgcacctgccgtgtctgtgattgtctcagtttctggagctctacccagccacgcactcagaagtgcgggctcagctgctgttggggtctggaatgtgaaggcgggagtgacagtctgagttcttggaaagccgaggccggccggttgcgatgctccgtgtttgcgtaccagagcaggactgtcttccgggtggctggtgaccgtccttcgactctgggctgtttcctgcagcacaggcagcagcaggcacagggcactaagcagcacacacgtgttgtactgagtgaccgtggtgcgctctgggggatgaggaacatggctgtttctaggtggtgacaatggcaccagctttgtgtttggtgcatagtagtgtgtcgctacgaagatctcaggcttccccacacacaccagcagcagagactaggaagcccaggtgctgaggtcaaggggactcatggacatgttggcgtgcgaggcctcccgggagctcatgctgggtacaggtgctgtgggggagcagaggagagagaagccctgccttcggggactcacagtgggcacagagcctcctgcccaagtgcccgtgagcaagactgtggacacatgcacgccgtggcacgtggagcaccagggacttaggtgtgtctgctggcagtggctttaatttggacaccagcagttcccagtgggttatcctgagaggggagcacatgcataagggttccaggggtggaatgaggatgaggtgaaaggggaggaatgaattcatgtgggggccatgagcgactgggaatgagtgggctcatccacacagcgacatgaccaggtcactaagaaacatgtggtcagatggatggatggaaggaagcaccagggcggggagcaggtaggggacggtcccaggaggccagagtgtccaggaaggggcagggcctggttctgtgtctgtgggtgggtcagggaccatctccctggagatgtcgggagatgcgcctgtcagctcagcaaggtcaggtgcaggagttgggggcctgagcggctgcgaggtgcaggatcccagcagcaccttccagtgcaggagctgcctttgaggggcaggggaaggtttgcttctcaaggcacagacaggttggggctgggaggctaagctcactgccagagacctcagccagagttcttgaatacctggaagcctatgaagttcgtcggaatgcttaatttccttagagtcattgaaaatgcaggaaaattgaaacagcagcaaaagaaaaaaatcaacacacatttgctttttatagtttatgctaaaaaatcttgactactggaatttcaattttttattattagttttatccttcagttttcaaaactgaatccatcttgtataggtgattgtctttcattttcattaggaattgaatgcagtaagttagaaattgctaataatactaacgatggctttgtgataagtgacagtatgcagtctcctcaccataaattcataccatgttcatttaaaattattttgttaaaacaggatatctgcaaataaacatttagcagggtctaacagacataaaacagttcctttttacaacaaatgaaaatgaatttctaactggagagctcttagtagctctgtggttgagtgagttggttccttgcgtgcagcccgtgacctggcgtggtgatgccgcacagctcagcaaggcgtccccctttggggaagctgggtgacatgcacataggacctctctctgctactttctgtactttttgtgagtcagattctttcaaaataaaaaatgaagtaaaaatgacattttcatttggggtcagggtgggggaatgggtacagtgctttttgagttgtttgttcacctttaaaataataaatagtacctagaaatctaaatattttgttttggggcttttgttgctactggaggttgaatttttgcagaactagtgtttttcttgttattctcaagtggcctgtgatgtgtcttggcgtgtttgccgtgtctgcgggtgtcttggtgtgtttgctgtgtctgcgggtgtcttggtttgtttctactcatgaccgttcctcctcttgttctttgtagggcaacctccagatccatcacgtggggcaggatggtcagctgagtgtcccagtccccatgcacatgcgggcgttgcgctgccaaggggtggggttctcaggggagggggtgggacggtcaggtgagtgccctggtccccatgtacatgtgggcattgtgctgctgaggggtggggctctcatgggaagggggcggatggtcaggtgagtgccacagtccccctctcacatataggccattgtgctgccaaggaatgggggctctcatgggaggaagcgagggtgcaaaggcctctcagtgtgagccccagagcaggactggctttcctcaccatggcaatgcacaggcctggaagggggagggcggggcttgggggttacatttgctgctccgtaggatttcagcagcttttgcattatggcggaaacatgccctcccacccccaccaccccacccccttcagatggttattttctgcacacgcatgtgtatgttgatggtggtcatatttgcacagataactctgttagaaaaaggtggtttcgctcctgtgtattgccatcaaactcacaaacttgcctgctttctaatccttgacaaaaagagtgaccattggttgaacaccccagtacgaatggtctttacaaaatgatgtgctccgacggtgcgggtcctggggagggtgttgctgtgcaggacagagtcaactcgctggtggttttgaggctgtgtgttcctaggtcctggtgaagaccctttctgttcaggagatggctgtcacctctggatcattgaagaatctgggtgatcttcccatttcataaaacagaagctgggaagttgacagtgagaaccataaacagagctcactgtgtagaaagataatactaatttttcaaaaccacagcgcactgtcctatgagaaacctgcatgcgttccctttgtcaaggccaggccctgcagatctctgacccgactgagcctggggcacccccagagtgaggtgctttacacagagggggacagaagggcatgtgctcccgtgggctttctgttgacccctcagaggcaccttgggagaagggctgcagaccctccgaaactggtttatgtcagagtttcttagttggaaagtttcatcttaaagatcagcacgaggttttctcaggtagtcctgcagcatcgctcgtctgtaagtatgaaattgctgctctggaaaagagccaaaggaatgcgcagcttttaaatccacagttgtggccttgcgctcactccactggggtaatgaggctgcggtgggcgcagtgcaggtcagttctctgcgcctttgtcccccgtggttctcacggtcacgggggcagcagaggacagggctcatagctggcggtccgtcttagttttctgcaacatagtggtttatggttctgctggtagtggaactgtatcatagttgaaacgctgctggacgtttaattcctaggaaaagtaaggcacgtcaccttcgatattcccttgttcctgtctctacccctgaacaaaatccacttggaattttaaagatagaaccaggcttttacactgtatcactgcagtgcttctgtttgtgattgtagacagaattctcccaactctactgtggggacagagattccagcttttctcagcaggcatggaggcccattggctccagcacagatctgagttcaggaaggactcagggctgatgtcggaggagttgctgtctggatttctctgaacaagattccgttctggtgtctctcgttcctccgtcactgctgccgccccacgtgcctttgcactgcaagcagggtcgcaactgctgctcattcccgcctcttccgtggcccctccgagttcccactgtctctaagtggcctcaccgcagaatgaataaagctgccgtactaccactttttatgtgaaacaaataatttataaatcacctgtttttttttccccttgtgaactctcatacgctcctgattcctattatcggtcacatttctgggacctcaaatcaaagacggcttcaggagaggccggtgctgcactcagggtaacgggcggaatcttggtacatggcccctgcttctcttgggaaggaaactgccgtgtgatttaaagaaaccactgtgttcaactgaagctgccttttctggtaaatctgtgtagtgaaccccctcgttttccatttgtggaaattcttttttttttccatcatttggccagttctcattcctgctgagctacaccctgctcatgcaggctttgtcctccgggctggccacacgtttgggagacagaaggatgtttcagaaagcacagagaagcccactcgcctcgatgttgttgactgggctaagaagccccgagccgtggggggggtcacacagcccatttgctctcctccccgtcccagtgcctacagaagccccgagccgtggggggggggtcacacggctcattcactctcctccccgtccccgtgcctacagaagccctgagccgtgggggcggtcacatggcccattcgctctcctccccatccccattgcctacagaagccccgagcagtgtgggggtcacacggcccattccctctcctccccacccccatgcccacaggaggatagtgcatgcaggtctagggctctctcttctccagccagacttgatctcagaagcatccttcatgtgacactgcagatggctcagctccccgtcctgtcccagaggcccttggcctgccctggtgtgagcactggcttgattgatgggagaccctgcagcccacgcttgttccaggtagttgggggaaggcgaggaacagcaccccaaccggagtaagagaacacaaagaaatggacgcggctgctttaagttcctagatcactgaggattggcttagtattcccttctgattccctagttccaactaggagtggttatgtggcaatagactcagaatctgacagagcagctagaaatcctcttgggagggtggccaggcctcccctcttccggccgtccattttccatcctggggccggggcctgtgccctgcgccctgtgccccacatcctgcacaccaccccctttccttgtgctgggctcacacttgttgctgttctcctcctattccacttctgagatgattgttgctattacttcttgtagttaattgattattttcagaattagtggacagcttctctgaaaatagcctccattcttagttccacggagggagggatgtacgctgtgcttgtggattgctgctggggcgacgggtttgaggccacgtctgcggccagcagcaatgtcagttccaggagggccttggtggctgcggtgctgggaagcgccattgtgctgcgttggtgtgaccctgtggcacctgctgccaggggaccattctttttgagtcatgttttcttcaaattaaatattgagagattctagtgacatcccacagttgccatttgctgtctgagtagaaaatatgaagaatcgcctgatttgaagctatgtggtcagtttcatgtccatagcagccttgcttttcttccttgctgagagatggactgccccgtctcacgctctttctgctgttatgtctctgtccgctctgatactgaggttccaggagggctgccttggcctcctttccctgtagcccacgacacccgcatcctctggcttctttgctgacagttgtggtgtgcgcttacatctggtgctgggttgcaggcagggtgggactcacagctgttcgttgactctgggagggctcccctggctgaggctgtctgctgacaggtgctctgcaggtgagcatgagcctgcactaaggaatgctgattagagtccatttcaggccctgttgggcacactgggagtgcgcaagaaccacagagcctgagagacacagtaggagggtgggagatgcagtaggagggtgagagacgcagtaggagcatgggagacactgtaggagggtgggagacacagtaggagggtgagagacacagtaggagaggtcgggagagccacctgcaccaaggcctcaggacagcgaatggcacagccatggggagggtgactgcctgtgcaaggccggaggccatgggcacccaggtccagtgaggtcggacggagcccccggtgctcagcctcctgtgaccagtgttggggggtagcagtagcggacggtgcatcccaaatgtgggcaagaagtttggaaagattggcagagcaccagaggcttcataaagagccatttgggaagacaaggttcgggggatggtggtgggtgcgcaggtgtggggacgcactggctgcatggtgcccgcttcctcctccccgagccgtgctctccagcgctgtgtctcagcctcccctccaggagcgctcacttcctctcagctctgggcccctgtggcctctgctttgccagctgcccagccgtgatgactagtttccactccagtgctatctctgtctttattgttctttttgacctctaagtgcacatgctgtcgtgcctcagtgttccagcattgctgactgggagagggaagaagaggtgagggagagggaagaagaggtgaagggctttcttagaacactgacattgaaattgcagctgaatctttaaaaaaaatgttttgtgctagctcacatctgtaatcccagtactttggggaggctgaggtgggaggattgcttgagcccaggagtttgatgccagcctgggcaacatagcgagaccctgtctctacagaaaaaaaaaaattagccacgtctggtggcatgtgcttgtagtcccaagctactcatgaggctgaggcaggaggattgcttgagcccaggaggcccaggctgcggtgagccatgattgtgccactgcattccagcctgggcaacagagcaagaccctgtctcaaaataaatgaagtgtacaattcaatggtttttcaaaaaattaaaatacttaaaaaattatttggaaccactttggctggtttcaaaggttgtgtattatctttcctcctgaataacaactttacataagagtgggcattgaggtcactgtgggaggtgcctaagttagagtctcagtctcgggctttgtagagcagagcccctgtgtgtgtgtggacgtgtgctgccctcctcgcctcctgccctccaccgtgtcctcatcatgcacctaatctgctgccttccagggaagccaaatagccactgctgttggagttgaaattaaaatgcagtggctggttctggtcatggctccaggcatgggtagctccttcgggtgagctgcgtagagctgagcctgggtctttggctgtttagatgcatttgtggctgtgttctgggtgcttcttcgttgagagtggagttgtggagaaatggctccttcatcagctgactacactgtgctgatttcttttgtccctgcctcactgggggtgtgaggcatccgggcagcattttcctttactggacaatcccctagtgttggctttgttgctcagtgagtatttgaaattaattatttgctgccctgggcatgaagatcaaatgatatcatagcagaaatttggaatgatttaagtagaggtgttattgtattgcccatatggttaacttaagggattgcagaattggtttgagtagaggacaggccttgtatggtaaattagaccagaatcaggggcatctggaattccctgaaattccctggagcagggagaggcagtctggtgtgccagcgattcacagagcgagagagtacattcaaacagatggtgccaggagtgtaaaataatgtattgtctaaggaatttcaattttcagttagtggtaaggataataaaatctttaatttggtgcagattttcagaagattctgaaaaacaaaaaaagcccttaaaaattaagagttgtaaggattgaaatttgcagggaggtggatgactttatttttgagtgcattttaaatgaaaattgatgggttttttatgaggtcatgggaacttttgcataaggtggatagaccagttggccacttcagggggctgacaggggaaccgctggttggtcatacctgcatcttggtgcagctgctttgctgccgtgggtaccctgagccagtgctgcatgacctgggcagactccctataaaggcgaactcgcattctgcggcgatgctgcctctggaatgatgagtgcatgcgagctgcatggctggactctaccagcatctgcgcaagccacagcaggaagcagctttccatcgcggttctagaaccctcctctctcactcatgcgtgtgcacacacacagtcggaacaggtccacaggacaacaggctacagcgagaaggcagctttccattgtggttccagagccctcctccctcgctcacatgtgtacacttacacggtccgaacaggtccacagaatggtattactgtgtgctgattgcattaatattttttattctgttttctgttctgcttttcgtttctctccctttttgtctctttgaaaactggctatgacacattgcattgattttgcaacccacacttcgaaaaatactggaatagatgatcgctaatgtctctttcttaagagtttgtagttctaaaagttgtaattgcgtagctgggactataggtgtgcaccactgcatctgtgtaattaagtaatttttaaaaatttacaactatataggctgggcacggtggctcacgcctgtaatcccagcactttgggaggccgaggtgggtggatcacgaggtcaggagatcgagaccatgctggctaacacagtgaaaccccttctctactaaaaatacaaaaaattagccgggtgtggtggtgggcacctgtagtcccagctactcgggaggctgaggcaggagaatggcttgaacccaggaggcagagcttgcagtgagctgagatcatggcactgcactccagcctggatgacagagcgagactccgtctcaaaaaaaaaaaatttacaactatataaagtttacactgcaaatattaatattcttcctctcatattttgataaatcaaaagataattgttcttgaattgggaagctttttaaaaaatcacattcaatctaagaaaaatgattataaatgtgctagttaaaaaaatgtttagcgtgcttctcagggcttttcatctagatcaggaaaattaggattatccatgtcacttgggcattagagtgaagtttccctgcttttcatctagatcaggaaaattaggattatccgtgtcacttgggcattagagtgaagtttccctgcttttcatctagatcaggaaaattaggattatccgtgtcacttgggcattagaatgaagttttcctgagaactgcagtcaggtttttggcatggctgaccttctgttggtcatatggtgggcatggaatggaagatggctcgatgtttgccgcggctgtccatgcccctctacgccatccacaagcctctgaccgagttgtccatgcatgcatttgagcgtttcttgcaggagaggccggggccaaaggaacgcttcagttgcagctgggctgtgccaaggggcctcagcaggagcaacccttgggggccagagcccaggctcttccagcaacaggaaggacctttcttccctctgcagcacctgtcgaacataacatgctggactcccttgttcattcccggcagagaagcgctcccctcaccccccacagagccctgctatgccgggcactcagaccagccaggggtgggggagcctgtgagtaaagtggagaattggaggtgtggtgccaccctgaccacagcacctttcttctccctgaggccacctcctcaaatactcttcttggccacagatgagggcccagctgtggttggcagatcttttgggagataactggatgtgtggggttgggagagttgccatgggtcccagtctcagggcggccgctccctcagtgtctgtcatcttgggatgcagcagtgtcgcttcctcgtgcttcagtgccctcttcactgcagtgggatggcagcagcacctgctcaggaagttggtgggttttgctgggtgcacacggcccacctgacactcaccagcctctgggctgcccttggcaggtgccgtccacactccagcactcagggaagggtggtgcaaatcctgaaaaaatgaccacacagacactggcacccaggtggtgagtaggcaggctgtggtctgcagacagaagctttaccctgtatacgtacaaggagtaacagctgctcatttgagtgaagtcactggactgcggcccttagagcctcctgacgcggaggtgggcctttcacttctgccttttgcgtgtgtgtgtgtgtgtgtgtgtgtgtgtgtgtgtgtgattttagagatactgttttaaaactgtgtactcaaagcattagttaattaactaggaagttttgtcttgtgaaaatgatgaccaggactgaaccttttaaaacagatcatctgaacctcatcgctgtaaagcaatctggactacaaagttcattctttccgtgaattaaatggtttggtaaagaaatactgagcgtaacatggacgtgctctagtgatcttagggagctgtgagctcatgcagtcttgggtgggagttggcattgtttatgttctttttttaattttttaaaaatgtttttaatttttatatttttgagatggagtcttgctctgttgcccaggctggagtgcaatggcaccttcttggctcaatgcaacctccgcttcctaggttcaggtgattctcctgcctcagcctcccgagtagctgggattacaggtgcccaccaccatgcccggctaatttgtgtatttttagtagagacaggtttcaccatgttggccaggctggtctcgaactcctgaccttgtgatctgctcacttcggccttccaaagtgctgggattataggtgtgagccactgcgcctggccttggtacttgtgatattttgatacatgcctagaatgtgtaatgactttgaacagatgtttgcttttttttttctttctttgagcagtctcccggggctagggtaagttcagagaggctcctagatctttgtttcttgtttatttcaccagttagtcattttcagaaatgaatcaaagatctaggagcctgagcctactctagcccccagagactgcccaaagaaagaaaaaaagaagcaaagatctgttgaaagtcattacacattctaggcatgtatcaaagtaccacaggtaccctataaatatgtacaaatattatgtatcaataaaataattttaataattttttttaaaaaaaagatctgttggagccgggcacggtgactcacatttagaattgcttgaacccgggaggcggaggttgcagtgagccgagatcatgccactgcactccagcctgggtgacagagcgagactccgtctcaccaaaaaaaaaaaaacgattcctgtccctgttgaattttctgccatgcttctgtgctccttcaacagccagggacggagggatccagtctgagaaaagccagcatcagggactacttcagtcctcatagaaatcactgccaatggctttggccacctcctgtgtcctggattatgtctctgcagcttcccatctcccggacgcctccttgagtccctgtgtatgagtgatttagtgttacaggctgggtgaggagctttgcagggatttagcttttctcagggccacctgccctcaggcttcctgggccctcatacttcttcttgtttatatcttatctgcctttgggggaatgaccttagaggaattggtgtgagtaagccatgaggttcttggtccacctccatccagccaagggcagctggcagctgggcacttacatccagcaaggcagaagcaaccctggctttgaagtcagactgctagggtgagtctgaatggcctcggggaaagttccctctgagccttcgtttttttcacttgtgaaggcgatagtctcgcctagcttgagggtttgtcagggggattcagtgagaacctcatttgaagcagctgctttagttcctaacacctaataaatgtttaaccacttaccctcctctcccaccaccctttcaactttgaacctcttcctccatgtcatcccttcttaaggtgctgaccttttggccacaaagaatggctctttttgttcccatcaggactagaattcttatctttttgttgcttggccctggtaatcaaagaaccaccaacacatttgcaaggcatctccagccttctcgttctggccgcccctctctgtcttagggagagtgctatactggcatggtgatgagatgaacgaaagggcagtctctggctgttttctgctgatgaggatgtgctgagcagcctcctgcaaatgagaagcagggaaaagaccaaactagcttagctcattagctgggcatggtggtgcccacttgtaatcgtagctacttgggaggctgaggcaggagaattgtttgaacctgggagactgaggttgcagtgtgctgagatcatgtcactgcactccagcctgggcgacagagcaagatgccatctcaaaaaaaaaaaaaaaaaaaaagacaagcttgcctgcctttgtcttacagaacaaaggacaggagattccactttaccccctcatcgtcataccatattcagttttctgtatatcccacgatgtagcatgcttttttgaaagcaggacaccgtgtttgtttactttctcttgacgcctagcatagtgtctgccactacacaggttgttcaataaaattatgttcactaaacaaatacatcttggttggaaggaagggcattattcattgcgtgcagtactgtatttcatggttcccgaggtaccatataccaggatcactacagcttgctacagggaaagtgattaatttttaaggaacaaagcaaaaattaatgaaaagcgacccagagctctacacagacttggcttgctgtctttgtagccactggaaacccaagtagccagtacagaatacagtatggaaaaatgaattattttccattccacttgggaaaggagaaagaaccactgctgttattggcgtttgatgcatttgatggcatgaccttggaatttgattttttttttttttagatggagcctcactctgttgcccagtctggagtgcagtggcatgatctcagctcactgcgacctctgcctcccaggtgcaagtgattctccagcctcagccacctgagtagctgggactataggtgtgcgccaccatgcctggctaatttttgcatttttagtagcgatggagtttcaccatgttggccaggctggtctcgaactcctgacttcaggtaatctgcccatctcgacttcccaaagtgctgggattacaggcatgagccaccacgcccggctggaatttgatgttcttttaatcactgatatatcatcatcaggttatagattggcagtcaattacaaggtgatcggggccattcagaatataccagagacacagttactgttgctgagctgcctgtaaaattgaagtctaatcttccctgtctgttcggcagccttgggcatcgaggatcttctgactttgaaacactggcttcccttgctttctgtgatgccatagcctattggcacactttcttcttttctgatccttgttggcatatcacttccataccctcaaatattattcatccttggattcattgttggctcttgtttctatgcatactgtttggattccttggtgaagttgctctgtatgtgcctgttattcttagtcatacccacagcccagagcacttcctcgaactctgtctcatgaatgtctctatttggtgtacagcacgggcttgtcagtctccaaaactgaattctgatcttcatccatatgtgttcctgtgtttcttgcttagtaaatggctctgccctttacccaggtcccctggacagctcttgggcttcctcccagccttctccttctccctttcctctgccccaaaaccagtcccacaaagagcactgttttctgtctctcacatgggtccctgagccacgcgcggttcctccatcgtcagtgagttctcttctttctccccgacttgtgttttcctgccttcagtcttgatcagctctgacgcactttgcatatcacggagtggtcttctttaattaccatcccactcccccacttattccccataaccccactaacttaaagctcttccgtgggtctcttgtagaattgggacaaagtatcgagtgcttgatatggcttcttgggctctcttccctgctggctgtgtctgtctctgttctacctcttatgccgtgccgtacgccagggctgacaggcagcggcaggtccaacatcacaactctttcatccagtttgcaaataaatgatggcctgagtcccacaagctcccctcctgccacacccctgccttgggactcttgagacctctccataattcagcagctaaagcactaatgccagatcctgtgtggggcagggccttcagtgccactgcctgtgctttgcttggtgcctctcagtaatttagatgattcagttctgttttttttttgtttttttttttttttttttgagacagtgtcttgctctgttgcccaggctagagtgcagtggtgtgatctcggctcattgtagcctctgccttctgggttcaagtgattctcatgtcttggcctcctgagtagctggcactacaggtgtgtaccaccatgctgcctaatttttgtatttttggtagagatggggtttcctcatgttggctaggctggtctcgaactcctggcctcatgtgatccacctgcctcagcctcccaaagtgctgggattacaggcgttagccgctgttcctggcccaatcctgtattttgaacagctctcctggtttctattgtcttgaaactcttcaagtctggcagttctttcccttctgctaccttccttccttccccagctctcacccaagctcctactggccaaacttctattctctcttaaaaaaaaatatggccgggcctggtggctcatgcctgtaatcccagcactttgggaggctgaggcgggcggatcatgaggtcaggagatcgagaccatcctagctaacacggtgaaacccatctctactaaaaatacaaaaaattagccgggcgtggtggcgggtgcctatagtcccagctacttgggaggctgaggctggagaatggcatgaacccgggaggcagagcttgcagtgagccgagatcgtggcactgcactccagcctgggcaacagagtgagactccatctcaaaacaaaacaaaacaaaacgaacaaaaaaaattggtaaaatatacataatgaaatttaccatttcagccatttgaagtgtacaattcagtgtgagtgtacttaatgtacattcacatgtcatacagtaatcattaccaccattcatctcagaacctttccacttttacaaaccaaaactgtgtactcgttaaacactaacactcactccctccagacccctgcccctggcagccagcattctactttctgcctcagtgcattctactactttaggttccttgtgccaatggaatcatgcaatatttgttctttttttgtctggctttatttagcataacatcttcatggatcgtccgtgttgtagtatgtgtcagaatttccttcttcttcttttttttgatggagccttgctctgttgcccagtttgctagagtacagtaagtagcgctatctcagctcaccacaacctctgcctcctgggttcaagtgattctcctgcctcagcctcccaagtagctgggactataggcaggcgccaccatgcccggctaatttttgtatttttagtagagacgtggtttcactatgttggccaggctggtctcgaacccctgacctcgtgatccacctgcctcggcctcccaaagtgctgcaattacaggcatgagcaaccgtgcctggcccagaattttcttctttttaaaggctgaacaatatttttgagggtatgtagagcccatattttgtttattcccatgacagttgggtgtcttccacttatgggctattgcgaatggtactgctgtgaatatgaagatacaaatacttgttttttccacttttagttcttttggggcatatacccacaaggacagtgctggatcatatggtaattctatgtttaattgttttttagaaaccatcagagggttttccatagaggctataccctgttgcattcccactagcaatgcacacgaggtccattttctccaccatccttccacatccttgccaactccacagccttgccagtgctggctttttatttatttttttgagatagaatctcgctttgtcacccaggctggagtgcagcagtgtgatcttggctcactgcagcctccacctcccaggttcaagtgattctcctgcctcagcttcccaagtagctgggattacaggcatgcaacactgtgcctggctaatttttgtatttttagtagaggcagggtttcaccatgttggccaggctggtctcgagctcctggcctcaagtgatctacctgccttggcctcccaaagtgctggaagtacaggcgtgagccactgtgctcggccaatgctgcctttttaaattagagaaaaggtatacagctttaattgtatacatggggagaaccagagagtgattaccacccccttttttcatatatatatatatatatatatatatatatatatatatatatatagtaattttattattttttgtagggacagtatcttactatcttgcccaggctggtctcgaattccttgccctaagtgatcctctcaccttggcctctcaaagtgctgggattacaggcctgagccaccgtgcctggcctccttttttctgttttcataattgccatcttaatgggtgtgaagtggtatctcatgtggttttgttctcttctctcttgaagtttcagaattgttttcaaaaagccattcatgagctccctacatggttcagctggactgtgcccctcctatagtcctgagttcttcttccatcaaacctatatatggaactacttgttttcttttttcttttctttttcttttttttttttttttgagatggagtctgctctgttgcccatgctggagtgcagtggcgcaatcttggcccactgcagcctatgcctcctgggttcaagtgattctcctgcttcagcctcctgagtagctgcgattacaggtgcacatcaccatgcctggctaagttttatatttttagtagagacggggtttcatcatattgggcaggctggtctcgaactactgacttcaggtgatccgcctgccttggcctcccaaagtgttaggattacaggctcatccttgtagctctagtgtcttgcaaggtacctggccacctgcacagtagaggccaccaaaggactgcattcaaaataaccacttgaagaccctgacttcagaacatgctgctcattttcccgggaagccaaacccctactctcagtggtctgtatgcatctttagtcagtgggaagcggtgataatatacccacaactgtaaagtgagagagaccgacttccttaatcttcagtggggatttttgaaaatggttgattgcactcaaagcagaatttgtattttgcttcattgggtcaccttgggcaacaatttcatttctgtagaaaattaattttggaggaagctgcatgtgccaggggagccctgggtccatccttttgatggtgaggggaagtccagttcctcactcgcccatccctgcttttggttccctgttggtgattttcttttgtattcatgcacgtgcaaatcagctgcttttggtaagggaagccttggaaggatgtctgctaaaggtgcagagaaaatgcagagctccgttcaaggtgaaaaaagtggttgacaactggcagaaagaagctggccttaaggaggaagtcagaagccagggtgctgtaccccttgggctgtgtgttatcctgggtcactggatcatggggatgtccacagggtccctcgagggtgggttcttgacacccagggtggcagggacctgggccagtggctatttactaaggggtatgaatgtgtcccagcatgttaagatctagtggagctggactgatacctattggccgaatgtgacctctgcctgtttcaaaggtgtttaatcctgatgtctcataaattaagactcaggcctgtaatcccagcactttgggaggccgaggtgggtggatcacttgaggtctggagttcgagaccagcctggccaacatggtgaaaccccgtctccattaaaaatacaaaaattagctgggcatggtggtaggcacctgtaattccagctacttgggaggctgaggcaggagaactgcttgaacccaggaggcggaggttgcagtgagctgagaccgtgccctggcactccagcatgggcgacagagcaagactccacctcaaaaaaaaaagtaaaaaagactcagtttggcctctgagttgtcagtttttagatcacagttatccagcctgagttccgtgggtcctttgctttgctcctttcagaatgtaaatgactcttcagctcatgatggcgtatgcccctaaaaggaagtgagatacaagttttagaagtccttcttagaaatttcccattttttttttttttttaaataagagacagggtcttgctctgttgccaggctagagtgcagtggtgcaatcatggctctctgcagccttgaacttcctggctcaagcgatcctcccacttcagcctctcaagtagctgggactgcacatgcatgccactgtgcctggttaatttatttcctactctttaataaaggaggtggtatgctgtaaactcttgtaggatgcgggtgtgttatgctgagccctggttctggaaggcagtcttgtggctagttggaagttggtagagtgacagagctcagcccctttttggcactctgctctgccaatccatttgtgccttgcagtcaggctggttcagtttgggatgtgacagatttgggagcacttgtattcactgagttctcaggctggcacatgagtgaacttggtttacctttgttcctggcatggctgataccatgtgtggctgattctgttagagtgtgccctcagattcatccctctgtcttctttggctttgatagaacccagattttgcttgaggctgtggtatgtactcctttatctcggtgagggattaagccagttttgagttttgttctttgctttctctgctcccttgtgattttctgggattacttgttctttcctgataaaaggggcgataaagctggcttcatcccattccctttcttcctgctcaattgtaaatgagatgcccagagttaggacagtcctctgggacagcgaggtcaaaaggttggaggttttggcctgacatagcctttgtatcactggcctatttccagactagcccagctccatggggttggattttctttgtgtgtgggtttttttgttttgttttgtttttagagacagggccttgctctgttaactaggctggagtgcagtggtgcaatcatagctcattacagcctcaaactcctggggtccagccatcctcctgcctccgcctcccaagtagctgggactacaggtgtgtgccgccacactcggctccttgtagttgggttttctgtttcctttctttagagatgggttcttactatgttgcccaggctggtcttgggttttctgtttttttcttttttttgtttttttttgagatggagtcttgctccattgcccaggctggagtgcagtggcaccatctcggctcactgccagctccgcctcccagattcacaccattctcctgcctctgcctcccaagtagctgggagtacaggcgcccgccaccacacccggctaattttttgtatttttagtagagatggcgtttcaccgtgttagccaggatggtctcgatttcctgacctcgtgatccacctgcctcggcctcccaaagtgctgggattacaggcgtgagccaccgtgcccggcgggttttctgtttttttgttgttgttgttgagcaatgcattgttttggggcagtgttgtcacattgatgagacacccctcaccccccatggctgtggagcacaggtgttgctcagcacctggtgtgttcttggtcttctatagatgattgtcagatgactgaagaacatgccctgtctcactgcattatttcctgtggttgcaaatgatagaaaattctttagattgatttaagaaaaaaaaagatgaagaaaattaatttatttattgactcaagtatctaagaaatcatcttggagttgagctggattcagggggcctgccttctcccaaatctgtctccatctgtcatccctcagcaccgcttctctgtggttgggtgtctttccgggtggggggtctctacatgatggggtggaaaatggccccaagtagctccaggtttccaggatgatgagagatcctacttctaggacggggtcggcacactccctccttatgggtcgtattatagggtttgtgagccatgcaatctccatcgcagtgactcagctctgccactggagcagaaactcagccacagaccatatgggagcaaatgggtgtggctgcgttccaagaacactgtgcttacagaaacagtttggaggccaaatttgacccccaggccgttgtttgctgacctcagcttctggaggagacaaggcctcttttctggtggctctggtagaacttgtgcgaagggaccctgtggtccagggctgagactggggtgaggttagtgacacactcactttggccacaaaattgaaggcggtaccaaaaaacttatcaatcaagataaatactatttttatgtaatattaaaaaaaatgaaagttgcatatgccatggttccggccagttaattgcctgccctgggttagctgtccacccctgcagtagggggaggttaggatagtgctgaaggatcccagtggaatgtgtttcccataggaaagaggggtgctcttactagaagaaagggaaagggaccaggctcggtggcttacgcctgtaatcccagtgctttgggaggccgatgctggatgatcatttgattctaggagttcaagaccagcttgagtaacatagtaagaccctcgcctctacagaaaaaaaaaaattagccgtgtatggtggtgtacacctgtagtcccagctactcatgagcctgaaatgggaagatcgcttgagcccaggagttcaagactgcagtgaactatgatcgtgccactgtgctctagcctgggtgacagagtgagaccttgtccccaccccacccctcaaaaacaaaacaaaacaaaaaaaaacccaaacaaggaaaaggaatgctgtttggtgcacgtgtagtagtgatattaatagttggttttcattgagcaccaattatatgccaggtatgttaataactatggctaacatttattcactgcatttattggatacactttacatgtattcctttttctcatttttccctcatagcaatccatacacataggtactgttctccccactgtacagatgaagaaagtagaggacaaaataagtttcccaaggtcacacagtgcctgaactagaatttgggacaaggtttttgtcttccttgtggtccccaaggtatgaattcttgggcatcggtgatagttaaggcttgatagaaactttcccaaaagcctggtgctgttagtcatcctctgttaataggtgtcccggggcagctgttctcaacaccccttcctggcacttgttcttgttggcattcggctttcaggtgtttggagaaccagaagcccttgcctgctttttgacttaaccccatgtttcaaagcagatcaatgtatatccctaaattaaattatggacaccgcaggcgctaattggcaggtgagctgcactttaaatagaccacattaattctggcagtggaagcggaaccctgctgggataattcttatcatcagcagcatcaccctgacaagctttaaaaggattctgtagcagtaagcaattttgcagaattgaaaggtgaaaacacactttaaagcgttcatgtagattcaaggtcggagggaggtgactgcatttttcaagacaggctgcaagtgagagtcacttgactggaaatgtgatggacgtaccgacaatggtctggggtattttgaaatacgttgttggccagctggcccagggcgttgttgtcgccagattccccgtcctggtttctgagtgaggtggagagtggaaggaaggctgttttgtacagttgtgtggattagactgatcggatgagcttgggaagtggattagtttgacatttagggatcgagacagaagacagtcttgagggacctgccctcttgctggtttttgttattcctgggaagtttattctaaatgatcccagtgattggcttgatccacaaatacttatgcacgctcatacggatgtatacatttagatgctgctaacacaaaaaggaacccacgcgaatgccctctgctgtgaagggaattaattattaagcaaatgctgattggtcatcatggactgggcactgtgctcggtgctttccttccctttctagttaccctagtaaccctgggcgattctgcacttttgtgttgattttatgggagaggattttcaggcttagcatggttgagtgacttgctcaaggtcatttggttgaatggactttttctctgttgtcctgcctgctagactggaagccccttagggacgagttcttgttgtctctagctggtgacacatagcctagctcggttcacagctcccaggaagaatgcagtggatcctagtgaagttgaattgaaacattagagtgaacttaactagcctgccatgcagtttctggagatgggtgtacttgcctccttctggaaggcaggttcaaagcctttgtcatgtttcagaggggactgtgagcctgtttagctcctagattggaagccaggtccgactgcaaagactcagcttcccccacttggaatattaaacagttgtgaacgtgatcattttgaagaaggccaagtcccctcattttgcagggcagtgtgatttagtggtttgcagtgagctctggggtccctttctgccatactgtttactaattgtgttgctgggtgagtcgcttcacttgtcctggcttcagaccttgtctttcacatggagatggccttggttgtgatgatgtcagatgtaaagtgtttactgcaatggctggtgcaaagttaatgctcagtaaatagtagttgctgttgctgctgttattattattgccagcatgaaaaactgttaaagagccaatgttaagtgaagaaaattgatcacaaaattatgtatacactagcattacaactatgaaaatatctggggttgggcatggtggctcccgactgtaatcctagcattttgggaatctcaggcaagaggatcgcttgaagccaggagtttggtactagcctgcacaacatagcagaatctcatctctacaaataaataaaaattaaaaaattagctgggcatgggggtgcgtgcctgtgtctcagctacatgggaggccgagacaggaggatcacttgagcccaggacgttgaggctgcagtgagctccagcctgggtgacagagggagaggccctgtctcaaaaataaataaataataattaacttaaaatgtatataaaaaattttaaaaatctgtgtacatgtggataaaaagtggtgggatgtgaggagatacaagtagttgtaggaatgactgtcttatggataaaaacaaactttcttaggtttcccataacgccttaaatctgttcctatcctcagactgagtaatttgacatgtggaaatctttcctaaggaactaggaatgaggacaattatttatgtataggggtgttctttactgtacagagggaaagttggccatgtgccatgcccttagcagtatggaaatagttgttttactggaaagccatcaaaaatcatctttgaaagacttttaattgtaataggaaaatgttcatgctctagacaagaaaataaatgaatcaggatccaaattacacatacaaatatgtatgcgtatacactcatacaatatgatgtggttttatttatttattttttgagacagagtggagtggagtggcgtgatcttggctctctgcaacctccgcctcctgggttcaagtgattctcctgcctcagcctcccaagtagctgggactacaggcgtgcaccaccacgcccagctaatttttgtatttttagtggagacatggtttcaccattttggccaggatggtctcgatctcttgacctcgtgatctgcctgccttggcctcccgaagtgctgggattacaggcgtgagctaccacgccagcctgttttttttttttgagacagagtcttgctctgtcgaccaggctggagtacagtggtgtgatctcggctcactgcaacctccgcctcctgggttcaagtgattctcctgcctcagcctcctgtgtagctggaattacaggcacctgccaccatgcctggctcattattgtatttttagtagagatggggtttcaccatgttggccaggctggtctcgaacccctgacctcagatgatccgctcgcatcggcctcccggagtgctgggattacagacatgagccactgtgcctggcctgatgtgttcttttcttctggctgctgtaacaaattaatacacaattggtggcttttaaacactataatttattctcccacagttctggaggccagaagtccccaatccatttcactgggctaaagtcaaggtgacagcagggctgcttccttccagaggcttcagggccgaatccgtttctggcccttccagagtctgctcgctgcccaccttccttggctatggctgccccattctagtctttgcttctctggccacatcatgtcctcctcttctgtgtcaagtttctctctgcctgcctcttatgaagatcttgtgattacatcagcctcacagggattatgcaagataacctcccagtttccagatcctaacacagttgcacagactcttttactatataaggtaatattcagagaattctggagcttaggacgtcgatatctttgaggattataattcagcctacagcaaatgttgattttattataaaaaagaaaagtgcagtaaaaaagactgaaaattcttgaaaatgtcaatattggtcttttctggatgagaggttttagagtcatttttatttttgatatactcttctgtatctcccacctttttttcttatttcattattgtttttgaggctgagtcttgttctgtcaccaggccagagtgcagtggtgcaatctcagctcactgcaacctccgtctcctggttttaagtgattctcctgcctcagcccgcccggtaggtgggattacaggtgtgcgccaccatgcccagctaatttttgcatttttagtagagatggggttttactgtgttggccaggctggtcttgaactccgagcctcaagtgatccaccacatcagcctcccaagtgctgcgattacaggcatgagccaccgttcccagcctcaatttttattttagattcagggggtacatgtgcaggtttgttacctgggtacattgtgtgatgccgaggttcagggcacgattgaacccatctcccaggtagtgaacatagtacctggtaggtagtttttccgtccgtgctctcctccctctctactctctctagcagcccccagtgtctgttgtttgccatctttatgtctgtgtgtacccagtgtttagcttccatttataagtgagactatccaatatttcgttttctatttctgtgtaattcgcttaggataatggcctccagtcatccatgttgctgcataggacacaattttgttctttttcaaggctgcatagtattccttgtgtaaatgtaccacattttgtttatctagtccactattgatgagtatctgggttgataccatgtctttggtgttatctcctaccttttccatgctaaggggatactctgttacaatctccaacatcgcctagaggctttgtgtgttcctctcccagtgctgagtgccccaggccgagtgccaggcacctgtgccctctctccgtagagcccgtgttctggtactacgtgaaggaggtcctcaacaagcacgagctgcaagcgcttctactccctgcgccacatcgcctcagacgtgggccggggccgcacctggctgcgctgtgccctcaacgaacactccctggagcgctacctgcacatgctcctggccgaccgctgcaggctcaggtacgtggccgggatgggacctggaatgggatggagcaaggggtgaagatcttggagtctgtagtcagaccacctggattttcatcctagttccccgatctggggcaagtgggcctccctctgacagctccggagtgttctgctgagctgtggagaaacttgggggagaatcattgagagactgcctgtaatgggctcggcatggcacttgcatacagccagcttggatgtggagagagctgttgtcctaggacatagcttcctcttcactttctggatttttttttttttttttttttttttaagacagagtcttgctttgtttcccaagttggagtgcagtggcatgaacacgggtcattgtagcctggaccaccctggctcaagcaatcctcccacctcagcctcctgaccagctaggaccctaagtgtatgccaccctgcctggctaatttaaaaaattgttttgtagcgatggggtctcagtgtgttgcccaggctggtctcgaactcctaggttcaagtaatcttcccgcctcagcctcccaaagtgctgggattacaggtatgagctaccatgccaggtgcagaattttaatttgggattcttgcattcattcaatcccaaactgaaaaaaacatggaaattttatattggggaaggaagtcatttttgtttgtttgtttgtttttgagacggagcctcactctgttgcccaggctggagtgcactgctgctatctgggctcactgcaacctccatctccccagttcgagtgattctcctgcctcagcctcctgagtagctgggattacaggcgtgtaccaccatacccagctgattttttgtatttttagtgcatacggggtttaatcatgttggccaggctggtctcaaactccagacctcaggtgatccacccgcctaggcctcccaaagtgctggggttacaggcgtgagctactgtgcctggccgtggccattacttttgctctgagaatggtggactagacaagttgttttgtgtccttgagtgatacggagtgaccctgatgaatcctgttctggttccttaagtaacttcctgatcagcaccgcccagatcttcaacagtgaaatttcactgaattcaataagtgggcagcttgtgagtagtgtggcgtgttcccttgattttatatcttgccctgtgttccctagtttaggtctcctcttctgctttatctactgctgtggtcacctctctactggtaatgtctcagatcttctgggattgtgcactggggctcttaaaaatacccttaaagttctctgttgcctgtggctccttgttcaattgtatggcaagactctatgtgtccaaaatgggagggcttgggagccaggaggactgacactgacgacacctgtgtactgctcacggtcggagttcggaggctgagaatgtctggacctctagggcattaaccagctttagttaaggaaaacacactcctgtttctttctttcctttttttggagaagtctcgcttttttgcctagactggagtgtagtggtgcaatcttggctcactgtaacctctgcctcctgggttcaagcgattctccttgcctcagcctcccgagtagctgggtctaccagtgcccaccaccatgcctggttaattttttgtatttttagtagagacgggtttcaccgtgttagccaggatggtctcgatctcctgacctcgtgatcctcccacctcggcctcccaaagtgctgggattacaggtgtgagctactgtgtctgacctactccttttttttgaagtgaatttctgtgaagctccttccagcatatcatttacgggtagttcagagttacatactcagtctcaaagttgaagtgaccaacaaggagaagtcagtccagcaggtaagaatcacagttgactttacctggatcaccagccacttccccagctggatgttgggaaaacacattcatttagatgcgtgaaaacgggctcagatttttaaaggattatgattttaggaatcaggtgcagtcagaatgtcagcttgagcatgtggtttgtacgtctactaacattttctgggaaagtatattggaaatgctcctcttctttctttctgttagttgtattcagtcacttcagtggctaatttttccagtctctcactcaactacaggtcatgtatccctgactttgctttagtgaaattgactttttccttgattaatttagaattcaatgacctggcggggaagttatggcattggggatttttggtttccattgcttaacatgaagtcagagagagcttggaagctggactcgggagacctgcttttaagccctggctggaccatttattggctagatgaccttggacaggccctgtgggcttccttgacacccctaccccaactgccatctagatttgtggggcatttttagcctcctagccttttccaaggataatgtgggctttcaggcctgtaacctaggcaggcattatattattattattattattattattattattattttgaggtggagtctcgctctttcgcccaagctggagtacagtggcgcaatctctgcttaccaagcctctgggttcaagcgactctcctgcctcagcctcccgagtagctgggattacaagcacctgccaccatgcccagctaattttttatatttttagtagagatggggtttcactgtgttggccaggctggtcttgaactcctgacctctagtgatcctcccaccctggcctcccaaagtgctgggattacaggtgtgagccaccgtgcctggccaaggcaggcattatattaaatgccctggttgatgaagccatagaggctctgtaatttctgtctgaaatggtctcttcttgtattaggcaaatcaggcgagccctgttggcaggcttggatttcctgtctgtctcttggggacattgcttgagtggaagtcacccacctgactgctccgttctactttgctgctttataaatacatttacatatcatgtctattttagtactctaaagctgagggtcgggggggaccagcgaggaagttgtaggatgtatgtgttcaatcttctgtttgtaaccagaagctttaaaccagcagagacctcagacaaatcatatccctcctggggtgaccaggtgcagatcttccagggagccgtctaatggaatttcctggttaatggacacagagaaccactgctaagaacgatttccttttctctttcaatctgcagtactttttatgaagactggtcttttgtgatggatgaagagaggtccagtatgcttcctaccatggcagcaggtaagcctggcccagaccagggcgccaggccttgtgacacatggcagaggggctgccttggggcagttccacagcgccatggaatgttgtgattcttctgtccctcaacaactcaatgagtcacttgctgctgtccttcttttactagcactgaatgttggtttttaaatttttatttctttaaagagagagcctcactctgtcacccaggctggagtgcagtgatgcaacctcagctcactgcaacctccgcctcctggattcaagtcatttttctatctcaaccttccgagaagctgggattacaggcgcctgccaccacgcccagctaatttttgtattttaatagagatagagtttcactatgctggtcaagctggtctcgaactcttgggctcaagtgatccacccgccttggccttccaaagcgttgggattgcaggtgtgagccaccatgcccaaccacagtgttgggtccatttatctagaatgtgagaccctggcagagaaagcgaagatttgaaggtttttagttgggctttggagatataatatgcattgcggggaattggaggtgggagacctatctttgaatcctggctttactccttgctacctggtgacctggggcagatgccgtaagctttgctgccttttctttcctctctgtgaggtgggaatcatgctgtctcagcagtcatcttcatggggctgtgagagaatcatgtgagatcaggagtcgcacacacgacgaatcaacatggagagaccctgggttgatgttagtcggtggactgttacattgttcaccctttgactcaaagggtgaaaggtggaatcagctggactgaagtgggcaacttgcttcctctttccaagttctttgttgcctcctttttgtttttccttgaaaatttatactaaactcatatatctgggcttatgttagtcctgtccattgatgagaaaaagaatttgaccatgatttcctttgtagatcataagatgcccagtgtaagtttctgtccacattaatgatgatgatgttaccagtgcacatttgatggtttatggagctgagtgttttgtgagagattgcctttaatacttacaatcctgtgaggaagataatattgtccccatcttacagataaggcgactggagtacagggagatgataagttgctggaccaaggtctttttttttttttgagacggagtttcactcttgttgcccaggctggagtgcaatggcatgatcttggctcaccacaacctctgcctcctgggttcaagcgattctcctgctgcagtctcctgagtagctgggattataggcatgcaccaccacgcctggctaattttgtagttttagtagagatggggtttctccatgttggtcaggctggtctcgaactcccgacctcaggtgatccgcctgtctcagcctcccaaagtgctgggattacaggtgtgagccaccatgcccagcctggatcaaggtcttgtagctagtaggtggcagtgctgggatttacccccaggcagcctgatcccgggacttgtgcctttacctcctcccagttgaattcttattcatattcatcttcctggctgttagggagagaatgtggcatgactcaactcccatgataacggatgtctgctgaccccagtttcatgggaggttgttttttttttttttttggaagccaagtcttgctctgtcacccaggctggagtgcagtggcacgatctcggctccctgcaacctctgtgtggcaggtatttttatacctatttaagatcaacgtgtctcctcttctgtaatctgttgtctgcagctgtcttctcttattggtggtatgactgcccatcagcaagcactccagacttttccctttttttggacaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctggtgagtgggaactggtgctcgaggcggagcagagggaatcagaatgtggctgatggggtggacatacctcatcatctgaaagtcattccaaggggaatggagtccagtgcacttgcgttttccatttgtgtttctgtttctcatcctcattcactctgaaagggctctgatggccttacctagatgtgagaattgctgggtggaaaaatgaacagctcaaccagagcgaatggaaagtgagggtgtgagagacaccgggagccagatgacgttgatcctcattcattcattcctttatttgttccttcatcgtattctgtgtgttaggcggtgagccgaataggaaagacagattgccagcaggtagcctgcagtctcctttgggatgggtgtgggtgggtagttcatgacaaaatatataatttaggatccttaggataagagggatgaaagccaagcatagactgctatggggaacatctgccattgggcttgcctctgattggggatggcatttaaggcctcaggaaagagaggagttgtcaggtttgactctaggctctggggaggcaaaagagagttgattcaggctgggcatggtgtctcatgcctgtaatcctagcactttgggaggccgaggcaggaggatcacttgagttcaagggttctagaccagcctgggcaatgtagtgagaccctgtctcaattttttaactttttttttttttttttttgagacagagtctcgctctattgcccgggttggagtgcagtggcatgatctcagctcactgcaacctccacctcctgggttcaagcaattctcctgcctcaacctcccgagtagatgggactataggcatgtgccaacatgcctggtttctttttgtatttttagcagagacagggtttccccatgttggccaggctggtcttgaactcctgacctcaggtgatctgcctgccctggcctcttaaagtgctaggattacaggcgtgagccactgtgtccagcctgtttttaaaaaattttaattaaaaaattaaatataaaaaaagaaagttgattcagttaagattaatttggtgagaagttttcaataccctttgattcctttgggacattaagatgttactacagcaaaattggaaattttgttgtagtatgtatgtgtatatatgtagagacagggtcttgccatgttgcccaggctggtcttgaactcctggcctcaagtgatcctcctgccttggcctcccaaagtgctgggattacaggtgtgagccactgcatctggttgaaattggaaattttgggcttaagtacttagtattctcaaatctcttaaacaaggcagtaactgtggccatccctttggaattattgatggtgaccctgcatgaaccttgtaggagatagggctgttgacagctttgtgtaacagacactgaaatttctacacccacaggagtagcagtcccacccatttttggaactgcttttgaggtgatctcagagttgtgctataccagtgaggcctcaccacatcacacattggtttagacagattgggtttttggaattggctcaaagtgtcttacatccaagtgtgatgattaaaataggggcacaaagtgtcttctgtgagagctggtcactaaggcaagcttgatttctttttcagttagcatttgctatataacaagtgatttaaaaatgtagtggcttaaaaccaccgcagttcgttacttttttgtgtaggttggcatggtggctctgctgctgggctccttcggctcactcatgggagctcgtggttagattggaagatctaagatggccccatccacatgtctggaatcagtgctggggctgctcagattctactcatggactctcatcctccagtcggctgaactggcttctttatgtatggggtcagggccactgtccaggagagcaaaggcaaagctgagaccttttaacgcctagctactagaactcacacagtgttatttctgccacttttttttttttttttttttttttgagacagagtctcgctctgtcacccagactggagtgcaatggcgcagtctcagctcactgcaacctctgcctcccatgttcaagaaattctcctgcctcagcctcccaagtagctgggattacaggcacctgccaccacgcccaactaatttttttttttttttgtatttttaatagagacggggtttcaccgtgtttgccaggctggtcttgaactcctgacctcaggtgatccacccgccttgacctcccaaagtgctgggattataggcatgagccaccgcacccggccctttctgccacattcttttggtaaaagcagggcatggtggctcatgcctataatcccagcaatttaggaggctgaggtgggagtattgcttgaggccaggagttttgagactagcttgggaagcacagcaagacctcatctctacaaataataataaaattagctgggtgttgtggcatgcacctgtagtcccagctactcgggaggctgagggcagaggattgtttgatcccaggaatttgaggttacagtgagctatgattgcaccaatatactccagcctgggcaatagagcgagatgccccaactcttaaaaaaaaaaaaaaaaaaaaaaggcagagcactacgccagccagattcaagagggtgcagaaatagacatcacctctggctgggaggagccacaaagacccattgcaaaggggcattgcacaggaatggcaggaatttgaggctgctcaacacttgactacaccccccagctggttctcctggtctcatctaccagctatgagaatattttccaaagtgaagcattgaagatcattttggtaatggtagcatccttcacatcaaagtgactgcttggaaggaacagtttcaaggtgtgctctgtggtgtgtttatttaaatcagtgggagaggcctgcatccattctgctcaatcttctgtacacagattttcactgaggattttaaaaagtctgaattcatgttacagtgtatttctcactagaatagtattttccacaacctggaagtgagttggtttcatcatccttttgtcttgcctactttttcttatactgtatcttttcttttttttcttttttttttttttgccagatgccaaatgcaaaaaggagcggaagaagaaaaagcaagtgaccaacattatctcatttgatgatgaggaagatgagcagaactctggggacatgtttaaaaagacacctggggcaggggagagctcagaggacaactccgaccactcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtggatgaaaacgaagatgacgtgtatggaaactcatcaggacggaagcacaggggccactcagagtcgcccgagaagtaagttcccctcacgcttctgtgtgtgtgtgtgtgtgtgtgtgtgtgtgtgtgtgtttgtatgtaagatggagtctcaccgtcccccaggctggagtgccgtggcgtgatctcagctcactgcaacctccacctcccgggttcaagcgattctcctgcctcagcctcccgagtagctgggattgcaggcacctgacaccacacccagctaatttttgtatttttagtagagatggggtttcaccatattggccaggctggtctcaaactcctgacctcaagtgatccgcctgccttggcctcccaaagtgctaggtttacaggcatgagccaccaagcccagcctccccttgtgcttttaatgagggggttaagttcaccgttttctctttctatggtattgggtgaaataggtctgcaagttttatatttgcccagggtatcattcattcttcaggtgttgatttaggagtgttatttggaaggagtgttatttgctcttcccttgagaactgaaagaggggaagagagtacatttgagggcacttaatacaaagttaatgtcagaatgtgtgccttgaaattcttgctttatacatacatctgtaattttcatttcacagggttcacagggtttcacagtctgatgagactgtgcctgttattgttttttatttttactctggattttccttgcatctgacttgccactagcacaggaagctcaggacgaaggcagcgttaggagaatagttgtggtatggtgacttctgtgtttatctgcaggggtgtgaatagctgtaatatccactgcacctgctgccttaacagtggagttggccaggcgcagtggctcacacctgtaatcccagcactttgggacaccaagttgggtgggtcatctgaggtcaggagtttgagaccagcctgaccaatatggtgaaaccccttctctactaaaaaaatacaaaattagccaggcatggtggtgcatgcctgtaactccagatacttgggatgctgaggcaggagaatcgcttgaatatgggaggcagagccaagatgacaccattgcactccagcctgggcaacaagagagaaggtccttctcaaaaaaaaaaaaaaaaaaattcccaaaataccccaaataagctagttacctcttaggctttgtggtgcacagtgccctcctaatcatgactactgcaaaatccagtccattaaagtgtaaaatgaggccaggtgcagtggttcatgcctgtaatcccagcactttgggaggctgagttgggaggattgcttaaggccaggagtttgataccagcctgggcaacatagcaagaactccgtctctacaaaaaaataaaaagtgtaaaatgaatatacagaaatgtatctctctatttgacctaaatcttatggatcgcaccattgcactccagcctgggcaacaagagtgaaactccgtctcaaaaataaaaaataaaaaaaacattaaacttcaagtccgggtgcagtggctcacacccgtaatcccagcacttcaggaagctgaggggggtagatcacttgaggtcaggagtttgagaccagcctggccaacatggtgaaaccccatctctactaaaactacaaaattagtcaggcatagtggcaggcacctgtaatcccagctactggggaggctgaagcaggagaatcacttgaacccaggaggtggaggttgcagtgagccgagatcacaccattgcattccagcctgggtgatagagcaaagctccatctcaaaaaattaaaataaataaaataaaataataaaataaattaaacttcagaaggaaagagagttgtagccttgattccttttttcccaagacactccttgaggcctatgcaaattttcccaactcctcagcagtcacagctaagtgggccaaagcaagggctagtggaaggagtgatcgcagaccccatgacacccttcacacagagccatagatgactactcaacttacggtcacgtcaccatgggagagtcaccaaacagcatctctctctgaaatgtcaacatctatacacccatctagtgtctggtttagggtggaaatgtgggtgtaagaaaagtaatttagaggtaattactggcagctgaggggaggagactgttcctcacccagccttgggttagtggagatttggtgcaatggacaaaaacagaggttttgatttggaggcgaagaaagggggcaatggctccagaggccaagagcagagaaggacagccaggaagtgggctgagcatggtggactcaggagatggggagccccatcttgggatgcctcagagacattgtggagggggcctggttttcctttttgaacattttttattgttattattaattaatttatttatttattttttatttttattattattttttgagatggagtctcactctgtcatccaggctggagtgcagtggcatgatcttggctcactgcaacctccgactcctacgttcaagcaattcttctgcctcagcctcccgagtagctgggactacaggtgcacgtcaccacacccagctaatttttgtatttttagtagagacggggtttcaccatattggccaggctggtcttgaactcctgacctcgtgatccacctgcctcggcctctcaaagtgctgggattacaggcatgaactaccgcacccggcccttttctttttttctttgagacagagtttcactcttgttgcccaggttggagtgcaatggcacaatctcagctcaccgcaacctccacctcttgggttcaagcgattctcctgcctcagcctcttgagtagctggaattacaggcatgtgccaccatgcccggctaattttgtatttttgtagtagagacgggtttctccatgtttgtcaggctggtctcaaactcctgacctcaggtgatctgcccgcctcagcctcccaaagtgcttggattacaggggtgagccactgtgcctggcctacaaactggtctatcagcaaggtctttatgacctgtatcttgtgccaacctcctgtctcatcctgtgacttagaatgccttaacctcctgggaatgcagccaagcaggtcttagccttattttacccagcccctattcaagatagagtcgctcaggttcaaatgcctctgacactcctgcctcagcctttgagacagctgggactataggcacacaccaccaggcctggctaatgtcttcatttctattttgtagggacagggtcttgctatgttgcccagactagtctcaaactcctggcctcaagccatcctcccactacagccttgtagagtgctgggattacaggcatgagccaccacgccaggccttggtttttcttagtatgtgggctaaagtcattcaatgttgatggtaaaggaaaatggggccgggcaccgtggctcacacctataatcctagcactttgggaggcccaggggggcggatcacctgaggtcaggaattcaagaccagcctggccaacatgtcaaaaccccatctctgctaaaaatacaaaaattagctgaacacgttggctcattcctgtcatcccagcactttgggaggccgagctgggtggatcacttgaggtcaggggtttgagaccagcctggctaacatgtactaaaactacaaacattagccgggcacaatggtggctgcctgtaatcccagctactcaggaggctgagacaggaaaatcacttgaacccgggaggcggaggttgtagtgagccaagatcgcaccactgcactccagcctgggcgacaatataataataataattatttttttttgacagagacaaaaaataataatgatactttttttaaaaaaaggaaaatgggaggtgattgtagaaggtagaggatttggagtgatagttcattacaattgtaataaggaccacaagatgctaagagtaatgagatgtagcggacgtctgctatttttgcctgttcagcatccactcgttctgctttgtgtgatagcaccccaagcttcctttgaaccagtccttccttcagcggaggccgaccccaccccttcgctctgtggggtggccacatgacccaggtctagccaatcagcacattccatcccggagcagcagctgtgtgcccctagcccaagctaggctgctcctggctttgtgtacctattaggggaaaatgtgttctcttttcactgcagttgctaagcatgtgggatgtaagcctggacttgctggtggctgcctttgccaccgcttagggagattctggccaggcatgaagccggcacagagtaaatgaagcagggccaggagatgaggagagatggattctgattgcattatatgagtactaggatctgtgtctgaaatccaaatggctttttcttttcttttcttttctttctttttagaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcactttgggaggctgaggtggacagatcgcttgagcccaggggttcaagaccaacctgggcaacatagcaaaaccctgcctctacaaaaaaaaaaaaaaattctttttttttcgagacagagtctcgcactgtcgcccaggctggagtgcagtggtgcaatcttggctcactgcaatctctgcctcccgggctcaagcgattctcctgcctcagcctcccgagtagttggactacaggcgtgcaccaacagggccagccaatttttgtatttttagtagagacagggtttcacaatgttggccaggatggtctcgatttcttgacctcgtgatctgcctgcctcggcttcccaaagtgccgggattacaggcgtgagccaccggtgcctggcctctacaaaaaatattttaaattagcaggcatgatggtgcatgcctgtagtcccaaatgggcaaagttgttctctgattggctgaggtctttgtcacctgctccacccctgagctggagccccacccaaagtaattgactgaaagggggtgttctccagtgggaaattaggtaaggtttacattatttggccctaactcttcacccttccccctacccatgcccttggccatgtaattttgcagtgccctcctgtcacaggcaggatgacctgatgcctcttttttcttttttgagatggagtctcactctgtcgcccaggctggagtgcaatggtgcaatctcagctctctgcaacctccacttcctgggttcaagagattctcctgcctcagcctcctaagtagctgggattacaggcgcctgccaccacacccagctaatttttgcatttttagtagagaaagggtttcgccatgttggccaggctggtcttgaactcctgacttcaggtgatcctcctcgcctgccttgcctcccaaagtgctgggattacaggcataagccaccacgcccggccctgcctcttgagctggggagttcaagaccagcctgggcaacataatgagatttcagctctattaaaaataataataattaaaaaaaaaaagaatggccctacctttcactggcagggaagggtggagggccctcctgtcatctccaaatcatagtactgtccccaccagccatagctgatcattttaggagtggttccaaggagtcccaagctgggcccattacagcctctcctggagggttacaattggatgagaagccaatcgatatcctctataattaaaaatataagaacttaggagtcatggggcagctgtgtttagttgaaagcctagagaagcagagagagtccatgtgtttgttacttacggtaatgctggctgctggaacagataagccccgaaatctctgtggcttaacatcacagaagtttattacctgctcagataacagtctaaggcagatgtgccacatggcgattcagggactgctaccttgtggttctgctgtctctcggggcctcggctggtagatagcaaacaatgcagacaggagaagacagatccatgatcttaaccatctcagccccagacaggggaccgcgtcatttccacccaccttccatcagcaagaaccagtcacatgagcacatctaacagcaatgaaggctgggaaatacatgcccaggaagggaggaatcagtttctttgcagaggagagagggaacagaagagagggaaagggggaaaatagagagacggagggagagaaagagagaagaactaatgagcacagaactaagaaagcccaggcacagtggctcacatcagtaattctagggccttgggaggcaagacaagagaatcacttgaggccatgagttcaagggcagcctaggcaacatagtgggaccctatctccacaaaaataataatattattattattaaataaaataaaaggaagagacagccatgaagataactagctgaggccaggtacagtggctcatgcctataatcccaacactttgggaggttgaggtggacagattgcttgaggtcagaagttccagaccagactgaacaacatagcaaaaccccatccctactaaaaatacaaaaattagctgggcgtggtggcaggcacctgtagtcccagctactcgggaggctgaggcaggagaatcacctgaacctgggaggcggaggatgcagtgcgctgagatcatgccactgcactccagcctgggtgacagagcgagaccctgtctcaaaaaaaaaaaaaatcacctggcttgttaaaacagattcctggaccccaccccagaatttgattcaggttgggagtgaggcctgtgaatttgcatttctagcaaattcccaggtgatgctcatgccgctggtcccaaaccacactgtgaagtgccagttccagactaggagactccaaagagacactggagccaaccacaatgtgcaaacctgattgggtcctgatttggaaattaaacatctttaaaatgcattcagggaataattgggttcatttgaacgtggactcaatattagaaaatttctattgattttcttgggtagggtggtgacatgtggctggctataagggaagatgtctttatttttaggagattcacattgaagtcattataggggtcaagtgacatgatatctacagctaacttttatttcacttatttattattattattattttagagacagggtcttgctctgtcacccaggctggagtgcagtggcatgatcgtagctcactgcagcctcaaactcctgagatcaagcgatcctcctgcctcagcctctccaatagctgggactacaggcccacaccaccatgcctggcttacaactaacttttaaatgttggccaggcgcagtggctcacgcctgaaatccaagcactttgggaggccgaggcaggcggatcacttgaggtcaggagttcaagaccagcctcgccaacatgatgaaacctcgtctctacaaaaaatacaaaaaattagctgggcatggtggcaggtgcctataattccagctactcaagaggctgaggcaggaggatcacttgaacccaggaggcggaggttgcagtgggccaagatcatgccactgcactccagcctgagcattagagcgagactccatctcaaataaataaattaattaacatttcagcaaaatacacacatgcacacagacaaagaaaatatgacaaaatggtaattattgaatttcaggataggtgtatgagtgacaattataccactttttcaactcttctatgtttagatgctttaaatatttaaagctaggggctgggtgcagtagctcatgcttgtaatcatcatattttgaggggctgaggtgggagcatagcttgagcccagcagttcgaggctgcagtgagctatgatcacaccactgccctccgggctgggcagcagagcaagaccctgtctcaaaaaaatataaaataaaatgaaataaatctggggagcacgtgggggagggactagtgcatcacagcctaattgaacgagcaggagactgccatgggatgaggccaggcccaactgtgtcagtccctctgggtcattctaaggacttcggattctatcctgaatgcatgaggaaacccttgaaggccttaagcagagagtgacatggtctgattttcttttaagctgtagctttgtttttgagatggggtcttgctaaattgcccaggctagtctcgaactcctgggctcaagtgattctcctgccccagcctcccaagtagctgagattacagataagtgccaccacgcccagctaatttttgtatttttagtagagacggggtttcaccatgttggccagactggtctcaaactcctgacctcaagtgattcgcttgcctcagcttcccaaagtgctgggatgacaggtgagagccactgtgcccagccaattgtacatttttaaataactcaaagagtgtaattgaattgtttgtaacacaaaggataaatgcttgatgtaatggatccccatttaccctgatgtgattattatgcattgcatgcctgtattaaaacatctcatgcaccccatacatatatatgcctactatctacccacaaaaattaaaaaatgaaaacattatccttttgatgcttggccacatggaggacacagcaaacggttcatggccaagcacaagagagccactaatgtctgcaccaggaagggataattatccaattataacccagaggcagcctctggtgtcaatagctgattgttctgaacaagtccagattctatgcttccccaaagctgtgtgaaatttaaaaattcataatcattggcaaatgataatcgtaatacacatgccaaggcactacccagaccaaggaaatccaattcccttggcaccaggatcaaatccaagatccccaggggattctttctttctttattttgagacggattctgctctgtcacccaggctagagtgcagtgacgcaatctcagctcactgcaacctccacttccgggttcaagcacttctcctgcctcagcctcctgagtagctgggattacaggcacccgccaccacgcctggctaattctgtatttctagtagagacggagttttagcacgttggctaggctagtctcgaactcctggtctcaggtgatctgcccacctaagcctcccgaagtgctgggatcacaggcgtgagccaccacacctggcctcaggggattcttgattgcagccaggcagagcctgcagtcccagggtggggagttccagcagacctatgaaggactggctccagggtccctgagcacaaggttgcaaggccatgttgtcacactctggacctcttgtttgtttgtttgttttttgagacggagtctcgctctttcgcccaggacggactgcagtggcacgatctcggctcactgcaagctccgcctcctgggttcatgccattctcatgcctcagcctcctgagtagctgggactacaggcgcccgccaccgcgcccagctaaattttttgtatttttagtagagacggggtttcaccatgttagccaggatggtctcgatctcctgacctcgtgatccacttgtctaagcctcccgaagtgctgggattacagacgtgagccactgcgcccagccaacagataggtacagtctttatctgttcgtgtggctataagaaagtaccagagactgggttatttataaaaaatggaaattttggccaggcacagtggctcacgcctttaatcccagcatgctgggaggccagggcaggtggatcgtgtgaccttaggagttcgagatcagcctgggcaacatgacgaaaccctatctgtacaacgctaagaaaaaaaaaaaaaagcagggtgtggtggtgcatacctgtaatcccagctactcgggaggctgaggtgggagaatcacttgaacccaggaggcagaggttgcagtgagctgagatcgtgccactgcactccagccgaggtgacagagaccctgtctcatacaaacaaacaaacaaaacccagaaatttctttctcacagttctggaggctaggaaggccaagattaagttaccagcaggttggtatctggtgagggcatggtggccatttccaatatggcaccttgctgctatgtcctcccggggggaccagtgctgtgtcttcaagtgacagagggatgtaagggcaatgaaagggcctagctcgttcctgccaacctttttatgaggttactaatcccatgccctcatgacttaatgatgccccacctcttaatactaccagactggtggttaagttttaacatatgaatcttggggaacacattcagaccacagcagatatattgtagaaaagaatagtccgtaaattcccagcagtaacacttcgcatattttgcctcttattacttggagtatactgtgtttcatatggctttttaaactttgtaaaaactgcagcaagtgcctgattacttagggcttctttatctagtgacagactatttagtccattaattttgtgctgtacaacaggaaagagaaagaaaatgacttctgcagagactgaatcatctttatgtcctctatggtagttggcacttagtagatattaaataaaaaacaggctgggcaagatggctcatgcctgtaatcccagtacttcgggaggctgaagcaggtggatcacttgagctcaggagttcaagaccagcctgggcaacatggtaaaatcctatctctacaaaaactataaaaagtagcgggatgtggtggcatgtgcccatagacccagctacttggaaggctgaagtgggaggattgcttgagcccggggggtggaagttggactgagccaaggtccagctccagcctgggccacagagggagaccctgtctcaaaacaaacaaacaaacaaatctctttaactcccaaaatggaaagttctccaagatatatgttaagtgattaaaaaaaaaaaaaaaaaaagggccagcctggcatgctggctcatgcctgtaatcccagcactttgggaggccgaggaaggcagatcacctgacgtcaggagttcgagactagcctgaccaacatggggaaaccccgtctctactaaaaatacaaaattagccaggtgcggtggcgcatgcctgtaatcccagctactcgggaggctgaggaggagaatcgcttgaacccaggaggcggaggctgtggtgaaccgagatagcaccactgcactccagcctaggcaacaagagcgaaactccatctcaaaaaaaaaaaaaaaaaaaaaaaaggaaaccgcatctctactaacaatacaaaaattagctgggcaaggagctaggtgattatagtaccagctactcaagaggctgatgcaggagaatcactaaaccgcatctctactaaaaatacaaaacttagccaggcaaggagctgggtgactatagtaccagctactcaagaggctgatgcaggagaaacacttgaacccgggaggcggagtttgcagtgagttgagattgcaccactgcattccaacctgggcaacagtgcgagaccctgtctcaaaagaaaaaaataatataaagtgaccaggtgtggtgactcacacctgttatcccaccactttgggtggaagcaggaggatcactggagcccaggagtttgaaaccagcctaggcaacatagtgagaccctgtctctatattaaacacacacacacatgcacacacacacacacacacacacaaaggcagccagactatgcactaggaactgccctgggaatccctttgcgttctcacaacaatcccatttcacagatgaagaaaccaaggcacagaaatattaagtaatgtgtccaggtgcggtggctcacgcctataatcccagtactttgggaggctgaggcaggcagatcacgaggtcaggagttcgagaccatcctggccaacatggtgaaaccctgtctctactaaaaatacaaaaattagctggatgtggtggcaggttcctgtaattccagctactcaggaagctgaggcaggagaattgcttgaacccgggaggcggaggttgcagtgagccgagatcacaccactgcactccagcctgggtgacagagcaaaactccgtctgaaaaaaaaaaaaaaaaagaagaagaagaaatactaagtaacttgtctgaggccacttagttaccaagacgtgggagctgggacttgaacccaggcagtctgcagtctgactggattcatgcctgcagcctctgcactcctgctacttactgtgtgagaagcgcctgttctgtggaaggttgtgggctgagatctttccatgagttccactcatttacccccaaggctgttcttaaaggcaggcatgacagttatgcccattttacagatgcggccctgaggctcacaagggcacgccactcgcccatttccacaaagctatagctcgttagcggagggcagaattcggccgcctctcccctagctcgaaggctgtgattgacacagaggtttttgttgttgttgctgttgtttgttcttttttctttttttttttttttgagacagggtcttgctctgtcatcccggctggagtgcagtggtgcgatctcagctcactgcaaactgcctccaagatgcaaatgattctcatgcctcagcctcccaagtagctggaattacaggtgtgcactaccacgcccagctgttttttgtagagatggggttagtagagatttgtttaatagagatggggtttcaccatggtctctactaaaccctgtctctactaaaaatacaaaaattacccagacgtggtggcacatgcctgtagtcccagctactcaagaggctgaggcaggagaatcacttgaacctgggaggtggaggttgcagtgacccaaaatcatgcactctagcctggggtctcgcttttgcccaggttagagtgcagtggcacaatcacagtggctcactgcagcctcaaactcctgggctgaagggaatcctcccacctcagcctcccaagtagttaggactataggcatgtgccatcctggcgagttaattttttgtgtgtttttattctctcgagacagagtcttgctctgttgctcaggctggactgcaatggcgtgatcttggctcaccgcaacctccacctccggggttcaagcaattctcctacctcagcctcccgagtagctgggattacaggtgcgtgccaccatgcctggctaattttgtatgtttagtagagacagggtttcgccgtgttggtcaggctgctctcgaactcctgacctcgtgatccacctgcctcggcctctcaaagtgttgggattacaggcatgagccactgagcctggcctggtgagctaatttttaaatttgttatagagacaagagagacaagagtctctcttatgttgcccaggctggtctcgatcccctggcctcaagtgatcctcccacctcagcctcccaaagtgctgggattacagatgggtgtcaccgcacctggcctccgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagtgaggcaggcaggcagggaccaagcttgggcacagccaggaaggcaggacagggcatggtggggccaatggaatcattacccaagacgggcattttcagggaaacagcttagataaggccaggcatacagtagctcccacctgtaatcccagcatttggggaggctgaggtaggaggactgcttgagcctgggagttcaagaccagcctaggcaacatagaccccatatccacaaaaaatttaaaaaaggagtttgtgttcctgtagtagcatacttgggaagttgaggtggcagtatcacttgagcccgggagttcaaggctaaagtgagctgattgagccattgcaccccagcctgagcgacagagagatatgctgtctcaaaggaaatacaaattaaaaaaccagccgggcatgctggcgtgtgcctgtagtctcagctacttgggacactgaagtggaaggatcgcttgagcccaggagttcaaggctgccgtgagctatgattgtgcctctgcagtccagcctgggcgactgcagactgcaggacttttttaaagaccctgtctcttaaaaaaaaaaaaatcttagataagaggatgctgtgcctccctgggggtcttcagtcacccatggtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcgatgagtccccagcagcaccatgccacccaccccgagtatcccctgggcaccctggcatagccagatgacttccgtgcccctgttgcaataaccactgcttccaagtctctgtagaccaccccttgggtatatctcatgtaagtgatatttattttatttatattttttgagtcagagtctcactctgtcacccaggctagagtgtgctgacgtgatcttggctcactacaacctctgtctcctgggttcaagcgattctcatgcctcagcctcccaagtggctaggactacagacatgcaccatcacgcccagctaatttttgtatgtttttcagtagaggtggggtttcaccaagttggccgggctggtctcaaactccccacctcaagtggtctgcccgcctcggcctcccaaagtgctgggattacaggcatgagccatggtgtctggccctaatgtgagtgatctttaacactgagcacttgaaaaagaaaaccctgaagaaacctaattattcgatgtctggacgacaaggaagaagatagaaatggcatcagataataaacagtgtaaatgtttgtttatcagaaaggggctggtggtcgggacaagtaggaggatcgcttgagtccaggagtgcatctctacaaaaaagttaaaggattttttaacattggccaggcgtggtggcacacatctgtgatcccagctacttgggaggctgaggcaggaggattgcttgaagcccaggaggttgaggctgcagtgagctgtgatcgagccactgcactccagcctgggtgacacagcaaaatccagtctcaaaaaaaataataataatattttacataaccaaccacttctaaagattaaaaaaaaacccctatgattaaaaacctcaggtccctcaggcaatcataccagatatcgaaacaaagcaataacataaggactgcagtatttattttatttttatattatttatttattctttgttagtttttggagtgtgggttttgttttgttttttgaattttttattttgttctactcggttttattcttattgctcaggcttgagtgcactggcctcttctcagctcaacctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgaggttggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgtttggaaggtgtcttgagattatcatcggctgagggtggaagcggcccccgcagacgctcggcaggtgtcttgatattatcatctgctgagggtggagctgagggtggaaggggagtgagctgacgtttggaaggtgtcttgagattatcatccgctgagggtggaagcggaacccacagacgctccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgacggtggaagcggaacccgcagatgctcagcaggtatcttgatattatcatctgctgagggtggagctgagggtggaaggggagtgagctgacgctcggaaggtctcttgagattatcatccgctgagggtggaagcggaactgcagatgctcggcaggtgtcttgatattatcatctgctgagggtggagctgagggtggaaggggagtgagctgacgctcggaaggtgtcttgagattatcatccgctgagggtggaagcggcccccgcagatgctcggcagttgtcttgatattatcatctgctgagggtggagctgagggtggaaggggagtgagctgacgctcagaaggtgtcttgagattatcatccgctgagggtggaagcggcccccgcagatgctcggcaggtgtcttgatattatcatctgctgagggtggagctgagggtggaaggggagtgagctgacgctcagaaggtgtcttgagattatcatcggctgagggtggaagcggcccccgcagacgctcggcaggtgtcttgatattatcatctgctgagggtggagctgagggtggaaggggagtgagctgacgctcagaaggtgtcttgagattatcatccgctgagggtggaagcggcccccgcagatgctcggcaggtgtcttgatattatcatctgctgagggtggagctgagggtggaaggggagtgagctgacgctcagaaggtgtcttgagattatcatccgctgagggtggaagcggcccccgcagacgctcggcagttgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtggagctgagggtggaaggggagtgagcagacactcgggaggtgtcttgagattatcatccgctgagggtggaaggggagtgagcagacactcgggaggtgtcttgagattatcatccgctgagggtggaaggggagtgagcagacactcgagaggtgtcttgaggctcagggagttatcagttatacaatgttgttgagttggaggaggtggctggtggcccatcctgttttttaaagtttcagctgtgaggtagggccagtagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcataatatcacccttccactgagtactgccgacagctggagggtaaaggaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccactgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatctcacctcaagaagtcacttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcacgtgtaatcataggactcggcagcttttgaaggtacagaggccacacaagaaccagcttagctgagcatcatttaaggccttcatttggaattgtccctgtgggtaataagttacattcactcttcactagtttacagtcagggcccatctgctattacaaatacggaacctctgacacttagaatattagatcaggggccccactgggtggggatgaaggtgtttttgcgcaacacggttaccaacagggatgggactgtgatgcttgtaggcagcctttctctctgccatctccctctgcagggcttgagcacagagctgtagggagaaaaatgtatccatgtcctgacctggcagactatgtccaaaagcaaggaaaacaagcaaacttacccagttgcaaagagcctttcttgcagaaggggggatctgaaaaagccaacacatgagaaattgaatgttgagagagtctaagggccgtggcatcatctgcatcagcactgaactatcctgcaactgcagggaggaagctccttactttgcatttgtggtagtcctctgcccgccgccgcaactcttgcgcacgttgaaacattttcctatggattacaatcactttcatcagataaagcaccactttcaggatgattttaaataatctgccatgtttctgttatcctcacaactgtacccttacacaatctatctctacctagaaaacgtatttcagatggctataagagtacagtctgagccggtcacggtggctgacgcctgtaatcccagcactctgggagggcggggcagatggatcacgaggtcaggagattgagaccattgtggctaatatggtgaaaccccttctctactaaaaatacaaaaaattagccaggcgtggtggcaggcacctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaaaactgtacagtctgatccaaactgttgctgtattgattcctcctcttgcttactgcctgctgacttctgagatgatagtttccttccccattctcagtacatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacatagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaatactgtacaaaggttaaaaacaacactccaatgggcgtttcccaggagggtggggttcagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccagaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcagttcacagagattgagggcagaaaaaggaaacggcctaaaaagggtaagtttgctgtgttgccctcacaccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaataaaggtggacaggaaataccctggcctttgtagggactgagcctgcaccgacgacctcaattgcagcctgtatggaggacccctgaccatcccccagaagtagactcccatctcttctgcagcaagataacatgctactaggcctcaattcattgctaaacattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggccgggcacggtggctcacgcctgtaatcccagcacattgggaggccgaggtgtgcggatcatgatgtcaggagttctagaccagcttggccaatatggtgaaaccccgcctctactaaaaatacaaaaattatccgggcatggtggcatatgtctgtagtcccagctactcaagaggctgagagataagaatcgcttgaacctgggaggtggaggttgcagtgagccaagatcatgccactgcactctagcctgggtgacagagtgagactctgtctcaaaaaaaaaaaaaaaaaaaaattggtcaaatgtggtggcacacagctgtaatccaagctactcgggaggctgaggcagaattgcttcaaactgggaggcagaggttgcagtgagccaagactgcaccatagcactccagcctgggcgacagagcgtgactctatctcaaaattaaaaaaaaaaaaaaaaaaaaaaaaggctggctgtggtggctcacgcctctaatcccagcactttgggaggctgaggcaggtggattacctgaggtcagaagttcgagaccagcctggacaacatggtgaaaccccatctctagtaaaaatacaaaaattagctgggcgtgatggtgggcacctgtaatcccagctacttgggaggctgaggcaggagaattgcttgaacccaaaaggcagtgagctgagattgtgccattgcactacagcctgggcaacaacagcaaagctccatctcaggaaaaaaaaaaaaaaaaaaaaaaaaaaaaaagagaaaggaaaaccaatgccagtactagcaactcctcttcccccgaaaaaattacaaacaagaatgtaggaagggaaaggaattatacagcttaaactaatgaagcagaaaggacaaactcaattttgaacctactgaatttgccacaaatattgtagaaaatattctcaaggactttacagttgtctactttgattggcacatggttcctacaacagtatttgtgtcaaggcacatcttactgttttctggcggtcttcctctttccattgattttgtcatgacggttgattttcgttgtcaccttcctcttacggattttagctctaacttttgtttccacatgcctccgtagagtaatgacgtctttcaggccaattttatttcctcgaaaggaagaaactcttttctttgtgtgcatacaaatggacctcagcccttggtgagagtgaggagaggagaaggtgagaaacctgagggcaagaagctgttctttccctttccagggcaaactcatttccacactatgcggattccaacagagccataccttcctgtctacggcggttggacctccaggctctctgctgtacatccgtggatccatcatgtccatttcgagaccagaagatagtcttcaggagagacacctaggaaataataatataagaatgacggctgggcacggtggctcatgcgtataatcccagtacttcgggaagctgaggcaggtggatcacggggtcaggagcaagaccagcctggccaagatggtgaaaccccatctctactaaaaatacaaaaattagccgggcatggcagcgggcgcctgtaatccaagctactcgggaggctgaggcagagaaccgtttgaagctgggaggcggaggttgcagtgagccgagatcacaccactgcactccagcctgagcgacagaatgagactctgtcacatacacacacacacacacaagaatgacatgaggctggcacagtggctcactcctgtaatcccagcactttgggaggctgaggcaggcggatcacctgaggtcgggagtttgagaccagcctcaccaacatggagaaacactgtctctgctaaaaatacaaaattagccaggcatggtggtgcatgcctgtaatcccagctagtcgggaggttgaggcaggataatcacttgaacccagcaggaaaaggttgtggtgagctgagattgtgccattgcactccaacctgggcaacaaaattgaaactgtctcaaaaaaaaaaaaaaaaaaaaaaataggccacctgcggtagctcatgcctgtaatcccaacactttgggaggccgacgcgggtgaatcacaaggtcaagagatggagaccatcctgggcaacatggtgaaaccccgtctctactaaaaatacaaaaattagctgagcatggtgatgcacgcctgtagtcccagctactcgggaggctgaggcaggagaactgcttgaacccaggaggcagaggttgcagtgagccaagatcccaccactgcactccagcctggtgacagagtgagactccgtctcaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcaccccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagacattaaatatttcttctcatcatagcgaaaatgcaatgcaaatcccatctcagatgtcggtcagatacctatgaatctcctgaggtagtcattgaaatgacttttttcttgagatggagtgtcactctcaaccatgctgaagtgcagtggcgctaccttggctcacggcagcctccacctcccagattcaagcgattcttgtgcctcggcctcccaagtagctgggattacaggtgcctgctaccatgcctggctaatttttgtctttttagtagagatggggtttcaccatgttggcccatctggtcttgaactcctgacctcaagtcatccacctgcctcagcctcccaaagtgctgggattacaggcatgagccaccacacctggcctgaaataatctttcaaattctttgtagaatttgttttttcctgatttctgcacataggataaaaaaaaaatcatgtactaggatttcgagagaagcaatgggtaatctaaaaagatgaaaagagcaaccacgtcaatcccacagctactgctagatttcataggaaaggtagctggcccagtttggagctaggagaaatgtcaaacacatgaagaaatgacaagcaaggaaatgccatcatgcatgaatgcttcatggcacccatgatgtccctgcttaggaggtaatggtatagatgactagatgacaaggacaaagatgagaggtgcgaagttgtccaagtccaacagctcaactgaactttcctaagtggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacaaaaatttgctgggcatggtggtgggcacctgtaatcccagctacttgagaggctgaggcaggggaatcgcttgaagccaggaggtggaggttgcagtgagccgaggtcacaccattatactccagcctgggcaacagaaggagactcgtcttcggggtgagaaaagaaaaaaaaaaaagaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggtggtaaaactgaaacatacttcctcttcccttgaatataaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggtacaacttagcagccaaattcttaccaagtacagacttttgacatactgatctctctccagttccaagtcggaacatgcactttgaatgatgtcattcaaaattaccctgcccagacacacttttcattgattctcttggagggcagttctaagagtctctggggctttctctgcatcatgagacgcagagcagttctgcccttcaccttccggcagtttgtcacctcgtccctatgacctcagaggaactttgtctcaggccaattgtttgttccttggcctctttcatttcccctaaaaatcatttgctgcccctctaaatggcctacatctccatctatctccctctcccctcagaagagggtgctctttaagcatcaaccacccggcagttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagaatttcctatttaagtgacgaaacctcatactccatttgtgataaatagcacaaaggttaaaaaaacttatttttgaccaaaagctctgttgacattctattaaacaaacagtgacctatttaattttcataacgcaaatggcagatattttcataattcttatgctaataaatcatttccctgattttttgggtaaaaccacatattcataatgaagtccagaaatgtgaattgttttatataatttattcttatttgtgattacaagtatacctctacagaaagttagtatactcacccaaaggtaaactatccagagggtaatgacaactttataacttgtcggaaacgcaataataatatgtaaccaaggacttccaccaaagtcagtcccacgatgatgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagaagtcacatgtttttcagatggctggtagtgttttcaggcactgcaaatgtggggtgttgtctttcttggtataaagcagggatatccaatcttttgacttccctgcctatattaaaagaagcaaagttgtcttgagccacacataacatacacaaacactaacaatagctgatgatctaaaaaaaaacctcttttttttttttttttttgagacagagttccgctccactcagtcgcccaggctggagtgaagtggtgcaatcttggctcactacaacctccagctcctgggctcaagccattctcctgcctcagcctcccgagtagctgagattacaggtctctgccaccatgcccgactcatttttgtatttttagtagagatgaggtttcaccatgttggccagtctggccttgaactcctgacaggcgatctgcctgcctcagcctcccaaagtgctgggattacaggtgtgagccaccgtgcccagccatttttttgtttttgtttttgtttgtttttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggtcagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatggctaagacaagctaagtataaagtaattatcttttctttttgtttggagacaaagtcttgctctgtcacccaggctagattgcagtggcatgatctcagctcactgcaacctccgcctcccgggttcaagcgattctcctgcctcagctactgagtaactgggattacaggcgcctgccaccgcactcggctaatttttgtattttgagtagaaacagggtttcaccatcttggccaggctggtctccaactcgtgacctcttgatccacctgcctcggcctcccaaagtgctgggaatacaggtgtgagccactgcacctggccagtagttatcttttctttaaagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcaaattttagtgcttaaaaattaacaaggtgggccgggcgtggtggctcacgcctgcaatcccagcactttgggaagccgaggtgggtggaccacgagatcaggagattgagaccatcctagctaacacggtgaaacccatctctactaaaaatacaaaaaattagcagggcatggtggcacgcgcctatagttccagctacttgggaggctgaggcagaagaatcacttgaacccgggaggcagaggttgcagtgagccgagattgcaccactgcacttcagcctgggtgacagagcgagactctgtctcaaaaaaaaaaaaaaaattaccaaggtggagatcatgaaaatggcatgaatagtgtgggatttctctaagattgttgatattaattccattagactcttatgtgagtgaagacgaagacttcccctgagtaagttcagacagcttgtgataacatttctacgtcgattcctcaggatttaactatatattcttgaaaacatctcaattttaaatgtttctttcaagatggtgaattaaacagagatagcccttcaacaggtggaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggctgggcacggtggttcacgcctgtaatcccaacgctttgggaggccgaggcgggcggatcacctgaggtcaggagttcaaaaccagcctgaccaacatggagaaaccctatctctactaaaaatacaaaattagctgggagtggtggcacatgtctgtaatcccagccacccgggaggctgaggcaggagaatcgctcaaacctgggaagcagaggttgcggtgagctgatattgccccattgcactccagcctgggcaacaagggagaaactgtctcaaaaaaataaataaataaataaaataatgtagatcttgaaagggggtcggtttatgctggtgtatgtactttccaaagttagtaaacttacacttaaggttatatattttggccaggcgcggtggctcacgcctgtaatcccagcactgggaggctgaggcaggcggatcacgaggtcaagagatggagactatcctggcgaacatggtgaaaccccgtctctactaaaaacacaaaaattagccaggcgtggtggtctactaaaaatacaaaaattagccaggcgttgtaatctgagctactcaggaggctgaggcaggacaattgcttgaaccccggaagcggaggttgcagtgagccgagatcttgccactgcactccagcctgggcgacagagtgagactctgtctaaaaaaaaaaaaaagtcatcaaaccagatgacacaaatcaaatgacatttcactttgttttggtccactttgtttgttagagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgccatgatgccctggctagtcttcaacgcctggactcaagtgatctgcccacctcggccccctaaagtgctgggattacaggcctgagctgtgtaatttcatgccgcgtgacacagcccagtaaaaaggaagaaaccccgagggtccagcgtctactcacacggatgcactgatggctgataaattccagcaggagcccaaagaggagccaaaagagcatccaccgcccccgcatgtcctggtcctttcagggcgccctgaggcgtccaggacagaggtggaggtggcttagggcaggggggagggaaggggacggggaccgggcccggatctgagttggggagggggaggggagggggagggggaagggaaggggaggggaaggggggaagtaagggaagggaaaggaggagaagggggctgttgggcacctggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaattagagggagacaaaaaggttctgctatccgccaaaccttcttcggtctgggccctcccttagcaaacctggggctttatactccctctccaccaatccctgatgaccccggtggtgcctcacaatggacaatgccaagtagcgcccgcatcattccaatgacccctcccccatctcagtctcccacactcctcgcaaggacaggtcctctctggaaccttcacaaacctgatttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcagggtgcggaaggtcccgatagtaaaccatctccatcacatccatgtagccatccgtccatcaacctgtatctcaggaacaaatgtagatacattcattttaagcatgcatggtacatttacaaaaattaacctgacttattttgttccagcaaatctcaatatatttgagagcaatcaaatcacacagcatgtttctgatcatgtaactgtgctagaagtcaatgattaaaagctaattcaaaattattatttgcttggaaattcaaagtgcccttataagacataaacataagaaagaatccaaaatgaaacaagattgcctttcaactcaatgataagatcataacatggcaataaaatgtctccctctggcctgggaattcctctttgtggcacaaggttgtgtgatctcaaatcccccctaacccacctagacattttaacatccgaaaccgagtgatgatgtccttatctataatcatcttactgcctgtgtgtgtggactttaaattctgaacccaaatgagggggagaaaaccaagttgaccttcatgattgacctctcagggatgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggtctggtgaccaggacagacccccactgtccatcacctttcctggccctgtcctcagttaaacttcccacagggcttctgcccgatcacacagagtgtgcccaaactcactcaggcctctggcagctgaaaaccactgctttaaatccctttaccatttactatgacataaggttattgtaaacaggaaatattctattgatgctacaaatggaaagccaatgcctttaccataaatagaaaaacaaccctaagaaacaagcaaaacaaaaacaaaacaggggctgggtgtggtggctcacgcctgtaatcccagcactttgggaggccgaggtgggtggatcacaaggtcaggagttccagaccagcctggccaatatggtgaaaccctgtctctaataaaatacaaaaattagccgggtgtggtggtgggcgccttagtcccacctacttgggaggctgaggcaggagaatagtttgaacccaggaggcagagtctgcagtgagccgagattgcaccactgcactccagcctaggagacagagcgagactctgtctcaaaaacagcaacaactacaaacaaacaaaaaacagggttaacaaaactatggaattcaattctatttatatgctgcagccatgttccagccctagatttggctgggcatggtggctcacgcctgtaatcccagcactttgggaggctgaggcaggcgcatcacgaggttaggagttcgagaccagcctgaccaacatggtgaaaccccgtctctactaaaaatacaaaaattagccaggcacggtggcacccgcctgtaatcccagctactcaggagactgaggcaggacaatcccttgaacccaggaggtggaggttgcagtgagccgagatcgtgccattccactccagcctgggtgacagaatggaatgagactctgtctcaaaaaaaaagaagccctcggatttcggttgtgttggttgtaaaaggagagaccaagtaagtgggggttgaagtcagattagaccaaaagtgaatggcagagagtactataatgtccatgaagggttgctagagtcaccgtgatcatagcccaagcagagacagggaaaggaagatgtgagcagagtttggggtctcgaacaatggaggttattcgtgcagcccaggaaaggctccccaaagccaggatcaacctcccttgcagggggtccctcatggaggcatggccaggcaccttagatttgagaccagctatgttgctgctgaccagctgtgtgaccctgggctggtttccttccatacaatgggagtgccaatggctgcatgcatgcaaagaccgtctgaggataggaggaagcaatctgttgagcacccgtgtacctgagtgtcatcacctcccaagggcatctttcgttccagagctggcaccttggaaggcccttggtcactgaaggcagtgatgatggtaacagcagtaaatcatcatttacggctgatgagggaaggccaggggtagggctcctaggtcctggataagaatgagggtctgggcactcctggggacagctgagtggtaggactcctgggtccccagggggcaggtccatcttcagtggcattgggcctaggctgggatgctgagttatccactggagcatcagcagtacaggcaggcacagaggcagtggttccatcggaggtggcaggtgtaggatcatctggtgagcaagtagagtcaccaagtctggctgaccactacccccactacccccactatccccacagacgattccctgtcccttgcctcatgctccggcagggtacaggctcgcacctggggcctcatggagcatctctctaagacctctgtgtcctggtcattgaatgggcacttgagtcacccagggccattggaacaaagaggaagaatcaggccccacgatgttttgggagagtgtttagcacaatacatgcacgacacgggggcactgtcagtgtgggagcaatagtttacaacctccagccctaatctgagcactcttgaacctgtgcaatctgaaaggaacaggagacttgcaggaaaaatagtgcctggatttaacttaaaggaactaaaatgttggaatttttactcttgatatccttccagatcaactctctcaatgttcccatcctcaaaactatcatctggggtaactgaggcagtcagagatttactgactcaatgtcactcagttgattctgagttcactgctgattacatctgaccaaactgctttttctgaagtctactctgtttcatcatgctggtgatgattttgtgcagctctgggacaaactccacctggctgaggataaagcaaatctgcggtgacttagtcctcctgtcatttcccatcagttccccactctcctcctctgcccctccacagtctcccatgtaggctgacaccatatgacagccttaatggagtccaccgagtatttcaggttctctcctgggccacttgaaagtggatgtacccatgggatttgctttgacccaagagatgtgagtggaagtgaagtgtgtcacctcgaggcaagagttgggagccattgagactggccaccctctccttcatctcttagagcagctgacagctcccatatggaggctgctcctttattctcgtggcaggatgagggcatgtggggcacagggcacaggagagccatggaggatgtgcagcatgggcaagaaaagagccttcagtggtgtacatttccaccgtttggggctgtttcttacctacagtgatacctagcccatcctagcaggcatgcaccatctaccccacactctgtgatgcagactagcctgccgtcagaacatgaactggtggtcagacacacgtaggtttcagttccagctctgcctcttattgactgtaacctcaggcttaactttcagtctctgggcctcagtttcaactctgtaaaatgaggtggctataccatctcaggttgcagagagaattaaatgaaatataagtgcatgtagagcattgaacccagggcctggcacacacagtgagtactcaatgttagccatgtagcttcataatgcatactgattgtcaatattcagacaatccagtaaagtattaccaaaaataaaagtaaacttatttgcatatgtattctttcaatctttatttttaaacagggtaaaactatgcatattctttcatagccagtgtttttctcttcatagtatattgttaaaataattttatcttggaccgggtgcagtggctcacacctatagtcccagcactttgggaggccacggtgggcagattacgaggtcaggagttgacacgagcctggccaatatggtgaaaccccatctctactaagaatacaaaaattagctgggcatgatggtgcacacacctgtagtcccagctactcagaggctgaggcagaggaattgcttgaacccgggagacggaggttgcagtgagccaagattgtgccactgcactccagcctgggcgacagagtgaaactctgtctctctctctctctctctctctctctgtgtgtgtgtgtgtgtgtgtgtgtgtgtgtgtgtgtgtgtatctctatataaatctcaaaaataaaagatcatttttgagattatcattttaaaagacaagataatgttcaacttaatgactaatttaattattactattggactttttgtagactaaacagagcattcaaaacaaatgaaggagaataaaaaatatgtattacatgttgtaaaataaatgtgatgtggttaattcttttattcaaaattatagaacatatatatgtactatagaatgtatttattatgagtcatgttaaaaagtagtttagaagctgttgatttgaatttccttttcaaattttgcaggataattttttttttttttttttgacagagtctcgctctgtcgcacagtctggagtgcaatggcgtgatctcggcccactaaaacctccacctcctgaatctaagcaattctcctgtctcagcctcctgagtagctgggactacaggctcacaccaccatgcccggctaatttttgtatttttagtagggacgaggttttgccatattggtcaggctggtcttgaagtcctggcctcaggtgatccaccagcctcagcctcccaaaatgctgggattacaggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcgtaagcttcccccagcatcacccgctatgagatgtgtggcagctgagacccgggaactgctcaagggcaccaggccccatctgtctgcactcactcaccttcctcaggtactcgcatgggcatgtcactgactttacgtgctgctgcagctccttggtgagctggccctggtcatgggacaggaactgtggggtcaggacaatagagagcttcaccatttgcagaatgagaacaggggctcatgatgagtgccaacctattagataatttaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttctgtcataattagtgggatccatttcactattattggatatacagttctgtgcctgaaacctacaaaaaaagaaaatgttaagtctaaaaagcattagtgatttctcatttttatattactaattataaccctatttaatcacacaaggccttgtccgtggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataatgagaatccttagctcattcggttgtggtgaggggtgaatgatttggcacacaggaggggcttgttaaacattagctgtgatgatctccttccaaatcttcattttcagagccacagatgaggccacagtgcaaccaggtgaccttagagtgtaagtacacatgatcgccagctatgctctgtctccaccataggtccaagactgggtagttccggcctggaggtttctgctgcatctgccttctcagtgctcacctaagggcttttgtattttcctcctcgcatccccacagatggggttcaggctgccggacacagctgggtgatgccagggcagtggtcacctgtgccagccctgtgaggtagctggaggatcattgttccttccttctcgggctctgggcagatgccagggctggggtgacccatgccctcaagtttcttgctttggtgggccacattttcccttggcaaagagggtaaaggtcacaggatgccagagagctgtgacttctctgtgccctgggcccaaactatgaagacctgacacactatgctaaaagtccaaggctgggtgctccccagagcttcttgcctcaccgcttctgctgagggaggaatgaatactatgtcctcccagagctttgggagcttgtagcaagcagcctccccagcacaaaatctcttggaaacctctaactgtgtctgaaacattagtgcaaatgttgcatcatatttcccatatgtccgcatgttttaggaaaaaaccctcaatttcctaaatatgcaagaaaaatcgatattgtaggacaatgtgactttttaaaaaatgttatttaaaaatcttccccacctccttttctgccctccaagactgccaaatacttgttgaacaaatattattaaaagcctactacgtgccagccatgattcatggtcttggggacacagcagagaacaaactgacaggattcctctcttatgcaactcacattcttatacgataatgataagggttaacattaattaagccgtcaccacgtgttagtcacggtgcagtcattcccacacattattacacttaaacctgctagcaagcttgcaaggtagttagttgtttttcctttaaaaactgagtctcggaatgatgaagcactctgtccaatgtcacacggctagtaagtgtggagaccttgcatccaatcaatgcccgtctcattctaaaggccatgttatgtgttctccagcccatggagaataattttaacacagtcaatgaaatttctacacaacaatgttcttgtttcaagtccaagaatgcctcctacacctcctataatactggctttctggtgagtaaagatggcattctcatgtgtaatcaggtggcaaatggagatatgaccaaagtaaccatctgcctacactcataaccctgtacacactcttcctgtgtcgattcaattcaagtaccccttttgatcacttagcaaatctgacctttaaaagggttaaggtttttatatccatgtaagtttctgtattgctttggaagtctctggttaaattaatactcttttaatagtgacctgtgattctgttttgatcaagtgttttcaaacttgacgtctttgatgggtttctccagtgtcaaaatcctaaatcaagtctttttggcttaaaactaactttgggattttttcagctgcatcccttggggagtctaaagaatgtatctctcatcttgtagaggtattaagtgattcgatttatttggtagattaaatgggcaggcattgtcaaatgtggcgatactgcatgggagggcactgtcaagtgaggtgacattagatctcatctcagttatatttatgggtatgttgttgatatacgtgttccaaaaattgcatacatttatacaaatttaatatgatttgtaattttgatagttatgctaaatgtttgctaaagttatatttgtataaacacgtcatgaatggctgggcaccgtcactcatgcctgtaatcccagcactttgggagacaaaggcaggtggatcacctgaggtcgggagttccagaccagcctaatagagtgaaaccctgtctccactaaaaatacaaaaattagccatgcctggtggcacatgcctgtagtctcagctactcgggaggctgagacaggagaattgcttgaacccaggaggcggaggttgcagtgagccgagatcatgccactgcactcccgcctgggtgacagaggtagaatctaactaaaaaaaaaaaaaaaagttattaattatttctgaagattgtatgaaatttataaaagtctggtggccctgatatgatgctgccagtcatgattctgattactgtcttaaaatgctgcacgtaagtaattaaatttccttgtgaactgggaagtttcatcagacttctatcataactattgtttccatcatccacagttactattttgaattcttctctaaaaatatttgtaattggcaatagtccaaattttcttttgttttctttcctgtttttgagacacagtctggctctgttgcctaagctggagtgcagtggtgggatctcggctcactgcaagctccgcctcccgggttcacaccattctcctgcctcagcctcccaagtagctgggactacaggtgcctgccaccacgtccagccaattttttgtatttttagtagagacagggtttcactgtgttagccaggatggtctcaatctcctgatctcgtgatctctgcgcctcggcctcccaaagtgctgggattacaggtgtgagccaccgtgcccagcctaatttttgcatttttagtagagaggaggtttcaccatgttggccaggattgtctccatctcctgaccttgtaatccacctgcctcggcctcccaaagtgctgggattacaggcgtgagccactgcaactgactttttttcttttccttttttttttgttttttgagacagagactcactctgtcacccaggctggagtgcagtggcatgatttcggctcattgcaacctccacctcctgagttcaaacaattatcctgcctcatccttcagagtacctgggattacaggtgtgtgccaccgtgcccggctcatttttgtattcttagtagagacggcatttcgccatgttggccaggctggtctcaaactcctggcctcaactgatccactctcattggccttccaaggtgctgggattataggcgtgagccactacaactggctcagtaaatacattttttattatcaaaaaagagcagtgtatggttggcatattctgtgtagaatgtattttattgatgtctcctatttttataatttgcgagttaagtactttttaattaatgctttttagttttgggcagattcagttgactaaagcacctcatttccccgatacatgaaataaaatatttggcttcttttccaatttcacactgatgttattttgtgaaaatcagtgctttaagataaatctttatacgttaaggtaaacatgagaaacttgatctaatatttaatatttattcagttctacactttattaacttgtacaccagcagatttaaacattatgtaactatctcaagaagtttcacttggatgtaatgcttcacgcttgtaatcccagcactttaggaggctgaggtgggaggactgcttaaggcaaggagtctgagaccagtctgggcaatacagcaagatcccatctctattttaaagaaaagtttcactttgggaggccaaggcgggtggatcacaaggtcaggagatcgagaccatcctggctaacatagtaaaaccccatctctactaaaaatataaaaaattagccaggcgtggtggtgggcgcctgtagtcccaactactcgggaggctgaggcagaagaatggcgtgaacccaggaggcagagcttgcagtgagctgagattgcgccactgcactccagcctgggcgacagagtgacactccgtctcaaaaaaaaaaaaaaaaaagtttcagcaaattccatctaagaattccaccacagttctgttgtctccaatgtcatcttccacagatttcaagttgtgaagccctgaactgttaatttatcttgagaatgtatatttaagcttaatttaagactatatacctaaaaattgagcatataatttctataatttatttatgtaagtttctgtaagtcataagtatgtggtttccaagggtataatttatctgaatgtaataggcattaatatattttacattattgggaccatagtacagaaatttctaaatggtttgtaaaataacttgttatttgtgttgttgtaaaagcagttaatacaatggaaaaacttgtaagaagaagatacagtttaacatcaaaaagtttacccaaggtaattatgagtactacacctggcaaaacttcacagaagctgtggtatcacttttacgatggaagaatagtgtttgcattttgtgtaaaagtacttgcggctgggcgtggtggctcatgtcccagtgctttgggaggcgaaggccggtggatcatctgagcccaggagtttgagaccagcctaggcaatgtggcaagagcctgtctctccaaaacctacaacaattagccaagcatggtggtgtgagcctgtagtcccagctacttgggagactcacgctggaggatctctcgagcccaggaggcagaagatgaataaataaatggatgcaactgaatgggatgaggtctctcttgaaggagagagcaaaagagatttaaatagtaacaattataataaggctgggcgcggtagctcacgcttgtaatcccagaactttgggaggccaaggcaggtggatcggttgaggtcaggagttcaagaccagcatggccaacacggtgaaaccctgtctctattaaaaatacaaaattagccggacatggtagtgcgtgcctgtggtctcggctactcaggtggctgagacaggagaatcgcttgaacctgggaggcacaggttgtagtgagccgataaatataaaaagtattagagtactaacagaggaaagtttccactgatcaccttttagctttaaataatacagaagcatttgcccagtttacctgtaattaaaaatcatgcatcattcacgatttatatcttttttgtttgtacaaaaatgaatacaagttattctcttttatctgtattgtgattggtttggtgagagggaattaggccacttgagagtttgtgtgtgtttaaaattttctggccaggcgcggtggctcatgcctgtaatcccagcactttgggaggccaaggcaggcggatcacttgagctcaggagttcgagaccaaattgggcaacatggtgaaaccctatctctacaaaaaatacaagaattagctgagtgccatggcttgcgcctgtcctcccagttccttggggggctgaggcagtaggatcgctcaagcccaggaggtggaggttgcagtgagccgagatcatgccactgcactccaggaagggcaacagagcaagactctgtctaaaaaaaaaaaaaaagaaagaaaagaaaattaactttggtatttcaggttgtatttaaatggggacttaacatgaactatgttcataacagttgaccaaattaagtgtagatcgtctctttaataaagagatcatctggaactgcaatttctaactcatacatcattgctagaaaccttatttgtttactgtttctcttccaaggaccatcagtcatcctttaaaattcatttgaagctctgaaaagatattttttgttacatgggcaatttacttttagtacagtaaaatgttatgtgaatttctacagcatgtttgccaaaatgaattgtatctagaatacgcttaatatattctggaggcagctttcatttgaaattaggttcatcttctgagagtatgaaaaagttaatgggtttttgtgcctgaagattttgatgttgcatttggctacatttaatccactttcacccataagttttagcatctaaaaaaatgaaatcactgctaatgcaattaaaatgcattatgaaatgcatttctgtccaggctggagtgcagtggcacaatctcggctcactgcaagctccgcctccctggttcacaccattctcctgcctcagcctccctagtagctgagactacatgtgcccgccaccacgcccggctaatttttttttttttttttaatgaggcggagtctcgctctgttgaccaggctggagtgcaatggcatgatcctggctcactgcaacctctgcttcctgggttcaagtgattctcctgccttgctgggatgacagacgtgcaccacaatgtccggctaattttgtatgtttagtagagacatggcttcaccatactggccaggctggtcttgaacttctgacctcaggtgatcccaccttggcctcccaaagtgctgggattacaggcatgagccactgtgcccagcttaagatctctgttttaatgttaatgctggtcagttgtgtctggattccagagggaggaaggtagaatgaggcatgttgacacctccccttcccatcatgacctaagctggtcttttcagtttacttttgaatgtccttgctcaacaggaagggtccattcagtcggattgggtggcttagaattttatttttggtttacatctcaactgtcacagcagccgggcgcggtggcttcacacctgtaatcccagcacattgggaggctgaggcaggggtatcacctgaggtcaggagttctagaccagcctgaccaacatggagaaacccccgtctctactaaaaatacaaaattacccgggcgtggtggtacatgcctgtaatcccagctactcgggaggctgaggcaggagaatcgcttgaacctcggaggtggaggttgtggtgagctgagatcgtgccactgcactccagcctgggcaacaagagcgaaaatctgtctcaaataaataaataaataaataaactatcacagcataaagtaggaggaatatttcgttactgtctatttaaactggttaatgcagaaaggaagtctggaaattccagttttaaagtaaaattttggacattgtaggattgattatttggcatagttgtgatgtttgttcctgcattatggttttgttggcagggcagcctttaaggacctgtatattttcttctagactctatatattccctgtgagtattagttgtatggtcaaactggcaaattttaccataggtataaataatagagaatgtggaagaatagtgaatagtgtcagagatagttaaaagtccatacaatagtagagaaggtaataagtaatagtggcttggactaaatatttgttgaataaatgttttaaaaaacaggctacctacaatttgtgttgaagatatgaatgaatgaagtttccacacccttatgtggagtcctgataagtaagcaacaataaggaagggtccccaggttggggagagccccaagttgagaacaataatgaacaattactgtatgaacaattgttagagacagctaatcacaaacaacctgcgggcacaatgacctcattccacacgtagcacccttcagcaggaccctataaaactttcctccagcccctgcctctttgcaggtagccccttctctgctgagctgcccactgcaacatattttcataatttctctaataaatctgcccttctttacctacaactatcttggtaaatggctttaccacctgcaaaactgaccctaggttgttgctacccgatatggtttggctgcgtccccacccaaatttcatcttgaattgtagttcccataatccccatgtgtcgtgggagggacctggtaggaggtaatcaaatcatgggagcaggtttttcccatactgttctcgtgatagtgaatacatctcactaaatctgatggttttataaagggcagtttccctgcacgtgctctcttgcctgctgccatggaagacatacctttttgctccttctttgccttccaccatgattctgaggcctctccagccttgtggaactgtgagtacattaaacctctttttctttataaattacccagtttcgagtatttcttcatagcagtatgaaaagtaactaatacactacccgagacaccttaggagatttgtaatagctgtaatgccaggtccaccatatttttagcataaagcaaatgttcatgcatgatatgactgcacaggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccgtctctacaaaaaatacaaaaattagctgagcgtggtggcacacacctgtagtcccagcaccttgggagggtgaggcaggaggatctcttgaacccaggaggtggaagccgcagtgggcagtgatcatgtcagaggtgtgtgaaccagagcaactccatcttaaataggagccgggaaaagtgaggctgaaactactgggctgcattccctgatggttaaggcattctaagtcacaggatgacatagaaggtcagcacaaaataccagtcataaagaccttgctgataaaacaggttgcagtgaaggagctggccaaaacccaccaaaaccaaaatggagacaagactgacctcccatcatcctccctgctacactcctaccagcaccatgacagtttacaaatgccacggcaacatcaagaagttaccctatatggtctaaaaagaggaggcatgaaaaatccactccttgtttagcatatcatcaagaaataaccataaaaatgggcaaccagcagccctcacggctgctctgtctatggggtagccattcttttattcctttactttctctcttttttttttgagatggagtctccctctgtcacccaggctggagtgcagtggggcgatctcggcttactgcaagcttcgcctcccgggttcatcccattctcctgcctcagcctccagagtaggtgggactacaggcgcccgccaccacacttggctaatttttttgtatttttagtagagatgaggtttcaccgtgttaaccaggatggtcttgatctcctgacctcgtgatccacctgtctcagcctcccaaagtgctgggattacaggagtgagccaccgtgcccctcctcctttactttattaataaacttgctttcacttcacactgtggcatcaccctaaattctttcttgcacaagatccaagaaccctctcttggggtctagattgggacccctttcctgtaactatcatgctactgcactccagcctgggcaacagagcaaggccctgtctcaaaaaaaaaaaaaaaaaaaaaaaaaggaacatgacttaatacattcattttggagggtaagtctctcaaaataggcctttcactgggggaaaatggtaaaaatactccctggtaattcaagaattggagactcctgagatgctgctcatattagctgaacacttatcaatacttcacttttttccatatatactcaaggaacaagtgctatttaaagtgtttcactccactgtgctaggtgcaagactataaagaggtgaggatcaacacttttatgaaaaccagtgtcattctggatatagtttcagatgctagtgcaaaggaagctcttggtatacggaaaaagtattcaacaataaattaggcatggttgcttccattttctgcctcacatactttttttttcgtggttaaagtgatataatgtctatgatattttagattggcagttgcaaactagtggtcctcagcgtgctttttatgacacctacaaggtttgaagactttgatttcatattaaaaatctgggtttcaggctgggtgtggtgttgcatgcctgtaatcccagcactttgggaggctgaggcaggagaatcgcttgaaccagggaggtggaggttgcagtgagccaagatcgggccactgcactcaagcttaggcaatagagcaagactccatctcaaaaaatgaataaataagtaaataaaatctgggtttcaggccaggtgtggtggtgcattcctgcaatcccagcactttgggaggctgagatgggcagacagcttgacctcaggaattccagactagcctgggcaacatggcgaaaccccatgtctacaaataatacaaaaaaattagctgggtgtagtggagtgtgcctgtaatcccagcaacgtgggaggctgaagtgagaggattgcttgagcctgggaggttgatgttacagtgagctgagatcgccctcctacactccaacctgggcaacagagccagaccttgtcttaaaaaaaaaaaaaaaaaaaaaattctgggtttctggcatctcaaaaaaaaaaaaaaaaaaggaaaggtcagggcacatggctgctacagtcctctattagcaatgtgccacagcaggggtccctgacccctgggccatggacatgtactggtctgtggcctgttaggaactgggccacagagcaggaggtgaatggtgggtaacaattgaagcttcgtctgtatttctggctgctccccattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagctccctatagactttgcttcctaccgtcttacgttctgccttataggcatttgagtttgcagcccttgtttttgttagtatgttatgctggtgacattgaccaaattgaccacacattaatgataagcttagttggtgatgacctcaacggaataacgtgacataagtattgtgacaatacttcttgcatgtatctgcaggtggaattgtaaacctggtggtccgagatggtctaattccatcttcctatgtatctccttatattaatagtggtaacatttgtgatggtgattcagcatttcaatgcctcttctcatggcaacaacaaacgttttccttctgaatcaacattaacctagatgttactgtggatcaaaattagactctacattttcaaccacagaaatactgggcagtaaaaatttttcttaatattgattgtctacataggttgtgtaattagcatgtgtttacagttctatgatttctgcgtggctgctacagagctggagggggtaaagcaacagtgttttctcagttgtgcgagcagcattacattataataaataggtaatattaaactgggctgatgagagttgcaaaagactactttaatgttcatatggaaccaaaaaagagcccacattgccaagacaatcctaagcccaatgaacaaagctggaggcatcatgctacctgacttcaaactatactacaaggctacagtaaccaaaacagcctggtactgctaccgaaacagacatatagaccaatggaacagaacagagccctcagaaataataccacacatctacaaccatctgatctttgacaaacctgacaaaaacaagaaatgcagaaaggattccctacttaataaatagtgctgggaaaactggctagccctatgtagaaagctgaaactggatcccttccttacaccttatacaaaaattaattcaagatggattaaagacttaaatgttagacctaaagccgtaaaaaccctagaagaaaacctaggcaatactattcaggacatagggatgggcaaggacttcatgtctaaaacaccaaaagcaatggcaacagaagccaaaactgacaaatgggttctaattaaactaaagagcttctgcacagcaaaagaaactaggatcagtgtgaacaggcaacctacagaatgggagaaaatttttgccatctacttgtctgacaaaaggctaatatccagaatctacaaagaccaccaacaaatttacaagaaaaaaaacaaaccccatcaaaaagtgggcaaagcatatgaacagacacttctcaaaagaagacatttatgcagccaacagacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacacggttggtgggactgtaaactggttcaaccattgtggaaaacagtgtggcgattcctcagggatctagaactagaaataccatttgacccagccatcccattactggatacatacccaaagcattataaatcatgctgctataaagacacatgcacacatatgtttatcgcggcaatattcacgatagcgaagacttggaaccaacacaaatgtccatcaatgatagactggattaagaaaatgtggcacagatacaccatggagtactatgcagccataaaaaaggatgagttcatgtcctttgtagagacatggatgaagctggaaacgatcactctcagcaaactatcacaaggacaaaaaaccaaacaccgcatgttctcactcacagatgggaactgaacaatgagaacacttggacacaggaaggggaacatcacacactggggcctcttgtgtggtgggggagggggaagggatagcagtaggagatacacctaatgtaaatgacgagttaatgggtgcagtacaccaacatggcacatgtatacatatgtaacaaacctgcacattgtgtacatgtaccctataacttaaagtataattttaaaaaataagtaaataaataaataaaaaaagaaacaattgctggctttgcaattctctttcctccaaaatcgccaaggcctcaatttactcattgctgaaaaaggacgactctgtatatttttaaatgaagagtgttgtttttacctaaatcactctggcctggtatatgacaacataaaaaaactcaaggatagagtccaaaaacttgccaaccaagcaaataattatgctgaacccccttgggcactctcttaattggatgtcctgggtcctcccaattcttagtcctttaatacctgtttttctccttctcttattcggaccgtgtgtcttctgtttagtttctcaattcatacaaaaccgtatccaggccatcaccaataattctatatgacaaatgctccttctaacaaccccacagtatcagcccttaccccaaaatctttcttcagttgaatctctcccactgtaggttcccaggccgcccctaatcccgctcgaagcagccctgagaaacatcgcccattatctctccacatcacccccaaaaattttcgccaccccaacactttaccactattttgttttatttttcttattaacataagaagacaggaatgtcaggcctctgagtccaagctaagccatcatatcccagtgacctgcacgtatacatccagatggcctgaagcaactgaagatccacagaagtgaaaacagccttaactgaagacattccaccattgtcatttgtttctgccccaccctaactgatcaatgtactttgtaatctgccccactcttaagaaggttctttatcatctcccccacccttaagaagtttctttgcaattctcctcacccttgacaatgtactttatgagatccacctcctgcccccaaaacactgctcttaactccaccgcctatcccaaaacctataagaaccagtgataatcacaccaccctttgctgactccttttttggactcagcccgcctgtacccaggtgaaataaacagccatgttgctcacacaaagcatgtttggtggtctcttcacacagacacgtgagacgggagttcgagaccggcctggccaatctggtgaaactctatgtctctactaaaaatacaaaaattagctgggcatggtggcgggcacctgtaatcccagctactcgggaagctgaggcacaaaaattgcttgaacccaggaggcagagtttgcagtgagccaagatcacactgtcaggcctctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactcttcaatgtactttgtaatctcccccacccttaagaaggtactttgtaatctccccaacccttaagaaggttctttgtaattctccccacccttgagaatgtactttgtgagatccacccctgcctgcaaacatggctcttcaccccctatcccaaaacctgtaagaactaatgataatccaccaccctttgctgactctcttttcggactcagcccgcctgcacccaggtgaaataaacagccatgttgctcacacaaagcctatttggtggtctcttcacacggacgcgcatgaaacacacgactgcacttcaggctgggcgacagagctagattccatctcaaaaaaaataaaataaaaaggagtcacctcccccgagaggcctctggaccaccccatctgagcaggccactcttccttctctatcttaccatcttgtttctgtcccagtagttagggctacctccagtaatcctatttgtccctttactgtttagtgtgtctcgcttgactagaagctccatgaaagcagagaccctacctgcctccttcgccactagacccccagggcctggtatgtggtgatcgctcagggcccattttcttcctttcctcctcctccaagggtggggaaagagcatcagaaggtctaggtggccccaggcccaaacaatgctcctttaaaaggaaaccagattgttacaaaggtcagaggctgaaaagttatttccgccttttatccctctaaattcttcacttcctgaaaaaacaaacaaacaaaaaaagccactgagggcccttggactaaatccaggcctgagttgctgggcagaggtcagtcttgtccagacatgggaaaaaaataactcgagtcagacaggtgggtcaccacagaacgaatccagcctgcaaatggcctgtgcaatcttcagctctgtccagacctgcctccctctggggatgcctttaaaggtgatgaatgatctggatgaatgggcttagaggataagagggaaaaacaaatatcacaggtcaaatcgttatttgtcttcaagtttaacaccgtctactggactaaaagatgtccaaagaatagttgttcaactatgtaaattccttttttttttttttttttttttgagacagagtctcgctctgttgcccaggctggagtgcaatggtatgatcttggctcactgtaagcaacctctgctcctgggctcaaaccattctcctgcctcagcttcccaagtagctgggactacaggcatgtgcctccacgctcagctaattttagtattgttaggagagacagggtttcaccatgttgaccaggctggtctcgaactcctcacctcaggtgatccacctgcctcagcatcccagagtgctgggattacaggcatgagccacagtgcccggccaactacataaattcctaacaacgtatctccagaaagtataggcacaacagcacatgcagtcattcctgtaattaagtgctccgggaggccaaggcaagaagatcccttgagcccaggagtttgagaccagcctggacaacatagcaagactgtgtctctacaaaatatacaaaaattgggctggggatgatggctcacgcctgtaggcccagcactttgggagaccaaggcaggaagatcgattgaactcaggagctcgggaccagcctggacaacgtaacgagacccagtctctactaaaactcaagaaaattagccagacgtggttgcatgtgcctgtagtcccagcactttgggaggccaaggtgggtggatcacctgaggtcaggaggtcgagaccagcctggccaacatgatgaagtctcgtccctactaaaaatacaaaaattagccaggaacggtggcacacacctgtagtcccagctacttgggaggctgaggcaggagaatggattgaacccaggaggcagaggttgcagtgagccgagatggcaccattgcactccagcctgggcaacagaacaagactccatcaaaaaaaaaaaaaaagaaaagaaagaaagaagaaaattagccaggtgtggttgcatgcacctgtagtcccagcactttgggaggccaaggcaggaggatcaatcaaggctaggagtttgagactgcagaaggaaaccctgtctctaaaaacaaggtccagctaaaatcagggtccagctccaccacaagcgcagctccaggggctgttgagttttgcctctaccattccaagtagtctctgctccagaccaagtcccaccatctggcagtcatgtcagtccaaccacagtcatatcagggcacttccaggttctttcattgagtgccccttgaggaggctggaggagaggccaatgacatttgcacttgagactccagagtctagatttataaccactatgttacggctgccagagtggctgcaaggacacttctttcattcattcatttacaatacatgtagcatctgctgtgtgccagatgccattctaggttctagggaaacaaggcagagcccctgttttccagggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaagctaaggcaggagaatcgcttgaacctgggaggcagaggttgtggtgagccgagatcatgctactgcactccagcctgggcaacagagtgagactacatcaaaaaaaaaaaatagtaataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagagacccaacaggaaaaggaagagactgctctatggccaggcacggtggctcacacctgtaatcccagcactttgggaggcccaggcgggcggatcacgaggtcaggagatcgagaccatcctggctaagacggtgaaaccctgtctctactaaaaatacaaaaaaattagccgggcttggtggatgcctgtagtcccagctactcgggaggctgaggcaggagaatggcgtgaacctaggagacggagcttgcagtgagccgagatcacgccactgcacttcagcctgggcgacagagtgagactccatctcaaagaaaaaaaaaaaaaaagaacaaagaggagtccaggcgaagagaacagcagatgcaaaggccctgaggcagaaacaatcttggtatgctggaggaataggaaggcagccagtgcagctggagcaggataggttaagagaggatcaaagtgatgagggcctggaaagaggggctggggtcgaatcaacagatcctgttggttgcaatggaagagcctggagtttattctcagagcagtgagaagccactggaaagttgttttttgtttttctgtttttgagacagagtctagctctgtcacccaggcagactgcagtggtgcaatctcggctcactgtaacctctgcctcccaggttcaagcgattctcctgcctcaggctccccagtagctgggattacgggcacatgccaccacacccatctaatttttttttttttttttttttttgagacagagtctctgtcacccaggctggagtgcagtggcgcaatctcagctcactgcaacctccacctccctggttcaagcaattctcctgcctcagcctcccgagtagctgggactacaggtgcatgccatcatacctggctaattttttgtgtttttagtagagacaggatttcaccacgttagccaggatggtctcgatttcctgaccttgtgatctgcccaccacggcctcccaaagtgctgggattacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctgcctcagcatcccaaactgctggattacaggcatgagtcaaacacgcctggtcacacttctcatccagacctcatttgtccacctcccccatcccccgccccaccccacggtctgtcctataacgcccacacaacaggtcactgtttagaaagtgctacaaagttacaaacacagtcccttctgagcctcccaccaatgttggtgggtacaaggtcaaaaaaaaaaaatctcatttatgtaaggggcataggagactttttagttagagggcccaattatagtcctcctgaaaagatgccaaaagtccccttaaacacttagcagctaagattcaagaaagatgaatctcacattctttgtatgggaaatgaggaacttgacatcttcaatataatggattccactaaaataagatgatgatcaataggaaccaactaaaaaaatacttgactagctgttattgaaaggctgaaattcagctgacataagcagtaatattgagctagaaaataattcgcgttgaattcagcccaacttttgttttctgatttgggtctcttctaaattttttttttcttctggacattgggaacaatccaatttgaaggcctcaatgcccaaatctacactcttgttttattctatatccttggtttcttttttttttttgagatggagtctcactctgtcacccaggctggagtgcagtggcgtgatcttggctcaatgcaagatccgcctcccgggttcatgccattctcctgctgcagcctcccgagtagttgggactacagatgcccgcccccatgcccagctaatttttttgtatttttagtagagacggggtttctccgtgttatccaggatggtcttgatctcctgacctcgtgatccacccgcctcagcatctcaaagtgctgggattacaggcgttagccaccgtgcccggcccacacctaggtgatttttaaaattcttctagtagagacagggtctcactatgtcgggtcgccgtgtttgatgtcagttttccctgccagaatctacaatctccttgatcaccattatatcccaacgtagagctcagtacctggtacaaagcacatttgatcaatacttgctgaataaagaaataaaaatgaagaggcactccagcctgggcaacagagtgagatggtctcaaaaaaaaaaaaaaaaacgactggaaaggagatgagggtacttgtgaagccatattatatgacacgctctgtgctaggacttttatataccttgtctcatctcttcatctcatataatccttacaagtatctcaaaagtggggaaatccccatataactgaagacgaaggcagttcagaagttcactgatttgccctaaggttcctcaatttgcaaacgtcaggccaatgatccaaccccaggtatgtttggcagtgaaggaccagttgagtcatagctgcaagtaaccaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcttatgtcttcattaaaaacgggtgaagaatttgaacatttgcaaactaaaatacaaatggaatacactcaacatcattaatcatcaagaaaataaaattatgagataatcattaataatcactacatatgcaccacagtgattaaaatttttttaagttaagccacgtgacccaacaaggtgcattcactcaagagaaacgcaaatatatgtccactcaaagacttgcacatgaatgttgagagcaggtttatactgaatagtgcaatgtgaaaaaaccccaaaatctagcaaaggatgaagggagaaataaactgtggtatatatacatacaatagaacactactcaataataaaaaggattgtattcttgatacatgcaatatgggtgaaccttaaaaatatcatgctgagcaagagaagccaaacacaagagaacatgttgttatgatttcacgtacatgaaactttagtaaaaacaagtctaatccatagtgacagaaagcaaatcaataactgctgacaggggcaaatgagatgatcccaagggaaccttctggggtaagacgctgttctgtatcttgatcgtattggtggtcacacaagtgaagacatgttagaactcatcaaaccatacacttagaatgtgtaatataaacctcaataaagcaaaattaaaaaaaaaaaaaccacctttaattttctcttacaaaaaagaaaggaaaaccacttaactttaattttctccaacaactgattctggtacacagtataccttaatgcctgcatccatggcctcacgtcatgctgtttacatgaacataaagcttcaccgaagagtggaataagacagtcctgccagagaaaaaccaaaattactcaacgtaaaacaggctgttgatatgtttgcagatatatagcaagtcttaagtccaagactgcaatatagtttggctacttcagattgattgcaatagttttatctattacactatacccttacatcatttatcttctactcacaagaggcaagcacacagtaagagaaagccttttgttttgaagggaaatcttcttcagaatattaagtctaatttatcaatacattaataaagcacattacaaaaaaaaagtcacagcacatttactataaagcagactgcagaaaaacattacaactaatgctttattatgaagttctcgaagatcatcattcattcagaagcccccatctctggttgaactttaccccatttaggatgaagaagagagatctttgtttgcagcaaatctaaaatttacgtaatccgcctaaaggaactgtctttacatacaccacctcccaccccaaaaatagaagaaaaaacagagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgttgaaagtctgttagaaactgtgttctccaaagcagatgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctgtcaaactgacatccaaagttagggggcagtaagaggagcagcctgctctataataaaatgatattagcaagtcaagacatttgcttttggggatttttacattttatttcatttcaacctcagtttttgttggcaaacagcattcatatatcatatgacttctacaactaaaatgaagctattagcactagtatttagtaatctagtaactctccttccagccctcttcaccccatgtatgtttatcacatgatatacacaatgtacatttacctccgtaagagtaaacttactcagttacagactgccacttctgatcttgttctatcgggtttaaagcagttgccaaacaaacagaacttcttaacaattgaacttcaatggatttctgaggttcccttggatctggacttaacatgttacgaagcagttttttcatgtctacagaagttaaatgaaatgtcattaagttaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacaaagtcaggagttcaagaccagcctggccaagatgatgaaaccccgtctctactaaaaatactaaaaattagctgggcacggtgacagacacctgtaatcccagctactcaggaggctgaggcaggagaatcgcttgaactcagagggcggaggttgcagtgagccgaaatcgcgccactgcactccagcctgggcaacagagtgagactgtctcaacaaaaaagaaagtcggtaagtcaatctactatttaaggggacaaatctagacctgcattagcaaatcttgctcaatccagaatactcattaaactttttaataacattttataaagtgttccatttgtgacaaagaacttaattaatgagccacatcgatgaaaatcaagaaaaatatttagctgaaacactactttgtcctttatcaaacaaaatggctagataaatctcaaagtattaaagtggccattttttttatttgacttaattttaagtgcttttcatttcccaaatcaaacataaatagggcagccctaaatttgttgcttcacatgggattctgcccccccaaaaatgtaaaataacttccagattttccagtaaaatatactaagccaaacattttgagcaacttgtccactaaaataactttaaaactattttctcaaatacctacctattttttcttttgatcctccagcaagtagactgatattttctcctggtaacaattctaattgctcggtacattcaacaaattttccagactcaaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgccattattttggtttttatgttgaagatgtgactaccacttaattagtactcaaattggagtggcaaaccagaaagtcacagctacagactttcagtggagctgactcgcctgtgtctccttcctgttttcatgtgttgcagcctgttctcttcagagcctaacacactgacagtagacctctgcaggacaactttgacacccagttctctccaagctgccagtgagctccctgtgcagcctcactcctcacctacagcatgagcccttgcagctctcccagcatcacaatcttgtatctcagtcctggcttctttcactgctggcgtccctccgtctctccctttttcacctacttttcttttttcaaagaattcttctctttcatctgcttatatgaaaaataatgacacctctgaaattctttcctgtagtcctgcagcatcaatgccaggaagacagacctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcatcatttctgccattaaaaggtcctaagtcctctccagtggcaggttcctcaagtccccactatgctctataatgccctatgctttcagctaatgactcagtcctcagaaaaacaaacaaacaaaaaaaaacaggctttaatttcctctacccctacccccgatccaccatacactgctgaaattctgtctataccaactttgactgctttccttggggcagagaaaaggtgagggccagttaatctatcaatgttctttctcctgttccttcaacctctgctttctagtggctccttccccttggccaaaagaacataatctctccaacatttaaaataaacatctcatatttccctccagcaacagcttcctatcctcgacttcaagaaaaactcactgaccaaataacttacctcaagcttttcattttcaaatgtctctaccactcaatagtattcaatttagcttcttctgtctctctacaaaactctttttccttataatccctagagcatctgacaaggctgactactctcatctggatgtcctaatctaggacacttcccttctcaatgtccctgtatttttttgaatggcttcctcttctatcctttcacaaaaatgctaaactaggattctgacccaggccttccttcctcttcactcaatattctccagaggcttctctctggtttggttgcttacaaaggctctagagtatagacactgaaaaggaaagagggtcttttctgtgtactaatgatctgcaaatctctcaagcttagactttctccttagttcaaaatccaattcttaacagcttacccaacaatctcgtctgcacatttcattagaaatcttaaaacatggcttgttctctgtgtgctcctactccagttaatagcattgtttctcttccctctaccattgcccccacaaattaatggtctccatgcttccatacttgccccccacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggcgctcctaaacacacaggcctcccagctatttccagaacactccaagcccatcattctcacatcaggtctaggcccaaagggcatcctgatgggcatgccttgaccttgtgtcttccctccaaagaaggtcagctttacctaactgctttccttatggcacagaaaaggtgagtgaggtccaattaatccttctatcaataatctttatctaatctttgctttaaaaggttggaatttgtgtctgttttatgtgctgcctgggtcatagcacatgctcagtgaagcaattacacattaacccatttagcagtagaagtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaagcagtacaaatttttctttatattcactctggcataatcttcaaactgtattaaggttttagaacaacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcgtagttattggaaatttgttttataactggaaacagaaagccttactttatatagttgaagtcagctttcaggttgagggaagtgctactggtactctttttcaagtcatggatagcgttctgccattcctgcacagcagcccaatcggcaattgagatgtagcactcacatgctttatttcctaaataatttataacctcaggggaagagtcagtcggtttggacagcacagtttttctggattcacctgaaagtattttataaaataagaagagagagattcagatcaattagaaatatttcaaagagcacagaaacctaaaaacatgataagatcatcagtacgaaatatattactataacttttgctttatttaaaaatactgaacgctcaccattcagacaatgtttcgggctggcactgttacacccagcattggctaaggtgagcaccgatttgtcaaagctggagatgcagcaatgaacacctatcatggcacacaggtgttcctggtactccacagaggccttttcaaacctgaaaagcaaattgaagcagtcttatttctttatttatctacttacttactttttttttttttttgagatgaagttttgctcttcttgcccaggctggagtgcaatggcactgtctcagctcaatgcaacctctgcctcctgggtacaagcgattctcctgcctcagcctcctgagtagctgggattacaggcgctcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcacctggcctttacttacttacttatttgttttttgagacagtcttactgtcacccaggctggagggcagtggcatgatcatggctcgctgcagccttgccctcccaggctcatgcaatcctccaacctcagcctcccaagtagctgggactacaggcgcccaccaccacacctggctaaaacaaggttttgctctgttggccagggtggtctcaaactcctggactcaagcgatccgctcacctcagtctccccaagtactgggatttcaggcgtgagccaccgcgcccagccccaaaggaggctgttatgttaaacacacatatctcatttcccccctcccacaaaaaatggtgcaagaataaactgagctaaaacagtgagttgactatggtggggggaggtttgatgtcttcctcacaactatgaaactaaatttaaaagtggttaaatgttttttaaaaaatgtaagaggataaaagaactagtggaaaatattgataagtaactgatgtcagtgtgtggaaaggctttgtagaaggataaaatgcaagaaaagatgcacaagtaacagcatctagatgcataatgctgaaatacaacactaaacattaaaaacaaattataaatcaagaaattggatagcatcaacaatcttagtatttaatgaaatttcacagattaacacaggaaaaattgagaggccatgaagacatgatccatgttttaaaaaatcacaaatggtcactatatggggcaacttctactattagtcattaatacatatagaaatgtaaagtacaataactattttcgctgatggtggtggcagcattcttgtttctcagtgactctcagtatccacaaaggtgaagggaagggtgtactctattattaagggtatacattgcagccatcttttctgtagagtaacttagcaatagaatatatcataagacttatggtttggcagcctttcttctagtaaatcagtttatgagaatggattccaagaaagtaatcagaaatataagcaaagatattaagtgctatggtacatttagtaaaaaaaaaatcagaaacaaccttaatgcccaacagtaagaaatattaaattatggtacactcataaatacaaatctttattaaaaataacactgtagaatacttaacatggcaatttttttttttttttttttttgagacagagttttgcttttgttgcccaggctggagggcagtggcacaacctgggctcacagcaacctccgcctcccgggttcaaccgattctcctgcctcagcctcccaagtagctgggattacaggcatgtgccaccacaccccactaatattttttgtatttttagtagagacggggtttcaccatgttaggctagtctcaaactcctgacctcaggtgatccacctgcctcggcctcccaaagtgctgggaatacagatgtaagccaccgaacccagcctacctaacatggcaaatttttttttttaaatattgagtgggaaaaacagatcataaaaccatgtgcctatgtatgctgctgttttggtgaagaatggagaaaacgacatgaaagaaaaaagaattacaaagcatatggatatggaaatatgggactacaaaaggacacacaacagaagttactacaaagatatggaagaatgagcagttcttttattttcctaaattcgcaagatttcattaaactaacataaatggacacagaatattatggtacaagctcctctatctggaggaagcaatgagtctgaatgtagagttcacaggactaatgagcaaatactctgacaataaagggtaatttgtatcagactctgagggggaaggagctcaactagggatcaagttcaaaagcatttataaaacaactgacaggtcttgtttttcagtgtgatttgccactaattcttaaataagaaaggcactcaagtattactgctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctatcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttacttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaatgttacatataaaatagccacaaagggtgactaacagaaccttagcagcacatggatgtttgcacccccaccccaaagttacccaaacatttaacctgtgacctctgtaggaataacacatggagtaaaaagaaagcaaaaattaaatataaataaacaggaattaaagaatgattaacttcatgtgtttgaatactgcttgacattacctgaattgctaaacattttgttatttttggattccagttatttattgtgagcccactttcaagccaggaattactcaagcatttgtcatatgttataaaaacaatttctcctggccaggtgcagtggctcatgcctgtaatcccagcactttggaaggccaaggtgggcggatcacttgtggtcaggagttcgagaccagcctggccaacatggtgaaaccctgtctctactaaaaatacaaaacttagctgggtatggtggtgggtgcctgtaatcccagggactgaggcaagaagaggcttgaacccgagaggcggagcttacagtgagccgagatcacacaactgcactccagcctgggcgacagagtgctgtgtctcaaaaaaataaataaataaataaaaaatttcccccataaacaaattttcagaattacctttaaagttctaaactttgcacataagaaatatagttttaacatgttctaagatgaatattgttttaacatgaacaaaaacatgaacattattttaacttctaacactgttttaacacgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggtgattggtatagaaaaaagttctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcatggaaaccaaccttgggaggtgaagttaatgcattagcacatccctcgtatgcattatacattaatttctccagatattccagatactgcagaagaagaacaagtctaagttggttgttaccatggccttcatcactgtctgcagttgtccactgactaacatcctgatcagggtttaatgtgtgagctgcgagacttcgaatgatacctgaaagcaaagacaacattctgaatttttaaaaatcttaaaagttcctagaataagtgtgagttttttatgaccaattcacatttatcaagtatcctctgtctacccatcatttaaaaataaaaaatcccaacatgaaagatctttcattttaggggaaaaaaatatatattttttccacacaactcccataagttttgggaaaaaaacaaacatatttccaatgcaattattcaatgaaagcttattctaacaaacatacctgaaaattattgacttcttttcaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatatggcccactgccaaaggatagcatctgtcttcaggagattgcgtggaattgttgactggtcatgcttatccagtctctggcagctatagaacagtctttccaaccaattgtccttcctgggaaaagtagtttcatatttaaaagacaatgacaacttcattttaataatgaaaaaaaaatgcaaggggaatgggaataaggaactgtaattttccctactccaaaaaaaggcaaaacctatgaaattgagaagcattatgtcccccccctcttattttgaggtcttttatagttaacaggatgaggtacagtgtggaaggatgattagggtaaacggctcatgccggtcaggaatgaaactcattcaatgcaactaagcatctctagaatatctccacccccaccccattccccaaagtgttaatgacatcacatcagttaactgttaaccacatttcattactcaatttcaaagcccatttttgtttctacagatgctatcttcaaagtaattttcctattgatgaaaactgaaataacccatatgagaagaatgttacttgatactctgccacccccaaacatattttctcttcaaaactgcatgtaaagtcaagggaatcttaaaattatctttcctagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaacaaagttgttgttacgcaaaatattttagcttaaaaggttagcacatactgtaagtggattatttacttattaactcactggaggtaaaaatatagaaaaattgagactttcaaatggatacggagatgtgattacaactttagatcctttttttattcacttcagatgggtcatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaataaaagattactgtttagtttttcaaatatctgagctactaagaaacatattttggcactacatgagttattctatactaattattgtgagcctataaagctcattaaaaatttttaattttcttgcagacctgcaaaatttgattatttgacatcacttcaatcactgacaagcagggccataaaagatgtgtcattaatgctctaataggtgatctgtcttctcctaaagtagacaaccagtagaggctgtaaatatcacagaatgtctttgctccaaaacaactgttataccttaggataacatctaaaggaattgatttcaacagttttccaaatgcttgtcgaatacgagttccacagtgcactagttgaacacggcaaacatcaacacatctatgaaagaacgaaatagacaaagcaggtgtgttaacatttcaaagttattagggttaatgtcaaaagacatgatcttaatttcatacctctgtaaaagatcatctggcaaggaagaggacagagcaggtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactctagactaggcactgttcttgtccagaatcctcattgactgtcacgtttggaaaaatgacacattcaacaaaacccacgtaatgtaactgatgggtcatcacacaaaactttttctgagagaaaatgtaaaagtatatgcaaactataaacattcacgtaagcttaaaaatgtgacaatcacttcaaaacatttttctaatactaagaatgaaaaaaaatcaagactgtgtatctgtcattaaaatgaggattacacatctgcaggtcaggaaaagagctctattgatgaccatctcccattaccaaggattgataaacaaaatagaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacattaaaaacaataacaaaaacaaaaaaacgttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcatgataatagcaaagaggccgggcgtggtggcttacctgaggtcaggagttcaagaccagcctggccaacaacatggtgaaacaccatctctactaaaaatacaaaaattagctgggtgtggtggcgggcacctgtaatcacggctacttgggaggctgaggcagaagaattgcttgaacctgggaggcagaggttgcagtgagcaaaactccgtctcaaaaacaaaaaaagcatagaatattaaaaatctatatatattcttctatgaaacactgggggtgggggattgaggtttttcatgtatttcttttcagaaagaataagaaagcctagattaaataataaaaccaaattataaggtgtttgacagtaaagaagctgctctacctcacctctataatccacattttttaaaattttttgtaattcacatttcttattctcaaattataaaggcaaattaacaaagttaggaatagttaatactatataaaatctgttacctcgtgtcctggttaaggttatctttcttaagtaatattcacagaagatttaatataattgagaaatgtttctttgtggccgtagttacagtgctaatcacagctccatcaaacaaagaaggagaggaagaactgaggctactagagataaagtgatcatgcctgaaagacaaagcatagattatcttttcatctttaatcaaagaaagcaagcaagtccaaagttaaatcaacatacatctttaaaatctatccattaaaaaaataaaatgttttgtggggttcttaagaaaaatttgtgaatacagtacctggtacaatgagaatacaatgtgtagagcacagcatactgaatggcagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggactttttttatttggacatttttaaattaaaattacagattggaagggatctagtacactacaccttggacaaatacttttttgtgaagtcagtaaagcctttgcgtgcaatatagcatctctatgcaatgcagcaactccttgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccccatctctactaaaattacaaaaattagctgggcatggtggcgcacacttgtaatcccagctactcgggaggctgaggcaggagaatcgcttgaacctgggaggcagaggttgcagtgacccgagatcataccaatgcactccagcctagatgacaaagttaagactctctctctcaaaacaaaacaccagccacatacgaaacacaggaatgagagtacctgtgttccaagaaaactttcttgagtcggagtctctcgctctgttgcccaggctggagtgcaatggggcgatctcagctcactgcaacctctacctccggggttcaagcaactctccctgcctcagtctcccaagtagctgggactacaggtgcccatcaccacgccctgctaacttttgtatttttttagtagagatagggtttcaccatgttggccaggctggtcttgaactcctgagctcgggtgatttgcccgtctcggtctcccgagggattacaggcgtgaaccactgcgcccagcccaacgagaactttctttacaaaaacaggcactagtgttgcgatggttgtacacttctgtgaatatactaaaaatcagtgaattatacacttaaaataacaaacaaaaaacaggtgctgggctgtatttggcccacggaccatagtttgctgatctctggtctaaacagagccctttgtatgtgccttttgcggaagtagactgtatttcttcaattttccatatactgcaaatggcaaggtgccctgttcaataaggaaacaaaggcacaccctgccactatacaccttttccatccatcttgttcctttacactgccaagacactccattccacctgactgccccagccccacccactttctccttatttctagagtacaggacataaacatctttgaatctgcaaataatgtgaataattttcctcaaaaatcaagctttcatgtttgaagaagagtttattgtgacttcaaacataagctgtaactggtaataagcgaagcagctatggaattatacaaggcaatccaatcaaacaacatggagcacactgaagcgcaaacatcaaattttacctttttcctcctaaaaactttattccctaattacatccattactttctttctttgtttctttctttttttttttttcttttgagacagagtctggttctgtagcccaggctggagtgcggtggtgtgatctcagctcactgcaacctccacttcctgggttcaagcaattctcctacctcagcctccaaagtagctaggattacaggtgtgcaccaccacccctggctaatttttctatttttagtagaggcgaactttcaccatgttggccaggctggtctcaaactcctgaccacaagtgatcagcccgacgtggcctcccagagtgctgggtttacaggtgtcagcaaccgtgcccagcctacacctattattttctattaaaaataatgtttttcaactctgtgtggtccaataggaagaagaaatacacaaaccataaacaataaatacaaatcaagagcagggccacgtcgaattacttaaaaaaaaaaacacacgggctgggcgcggtggctcgtgcctgtaattccagcactttgggaggctgaggcgggtggatcacctgaggtcaggagtttgagaccagcctggccaacatggtgaaaccaagtctctactaaaaatacaaaaattagcccgtcgtagtggcaggtgtctgtaatctcagctactcgggaggctgaggcaggagaattgctggaacccgggaggcagaggtggcagtgagccgagattgcaccactgcactccagcccaggtgacaacagcatgactctgtctccaaaaaaaaaaaaagctttttttttcccccctcctaaaagaaagactacaggttgagtatcccttattcaaaatgcttgggaccagaagtgtttcagactctgtatatgtttggatttgagaatacttgcacatatataaaatgagatatgtgggggacgcgacccaagtctaaacacgaaattcacttatatttcatagacgccttctattcatagcctgaaggtcattttatgcaatattttaaataattttgtgcatacaacagtttggactcatcacatgaggtcgggtgtgggattttccacttggggcatcatactggtgctcaaaaagtttcaaattttggagcattttagatttaggattttcagattaggggtgctcaccagtaagtgttatgaaaatattccaaaatccggctgggcatggtggtgcccacctgtaatcccggcattttgggaggccaaggcaggtggatcacctgaggtcaggagttcacaaccagcctggctaacatggtgaaaacccatctctactaaatacaaaaaaattagccaggcgtggtggcgcatgcctgtaatccgagctacttgggaggctgaaacaggagaatcgcttgtacccgggaggcggaggttgcagcgagccaagattgcgccattgcactccagcctgggcaacaagagtaaaacactatctccaaaaaaaaaaaagtattccaaactccaaaatcaaaaacacttccagtcccaagtatttcagataaggaatattcaacctgtatgaatgttcctagggaaaaaaagacagccaaaatataagaccatgtataagaactaacttcagtagacagaaagaaaaaagtaccaggggaagaagaaagagaccgcattttaaaacaactatacaaatttgagctgtaagaaacactgacattttctataagcatgctagagcaaatgggagaaattcataagacgttttctagaaaataaaactaatataaaaaaacttatcaagatttgtcaaggaaaaagaagaaacgttaaatataatggcaagaaaacattcctaccaattttatttatccaggcatgtcttaaatatggctgtttgttacatacagtgattctgcagacatgttgacatgacagtgaaatacataaatatgtaatgagaaaaggcttaactgtggataaaacaaagtcattacaattaaagactcgagtttttggcatttccaattgtagtcagggcactgaggtcaaatttaactacaaattttgcattgtctacattgaacacatgattcttaaaagcctcatgttttatttcagaacaggcctcaggaagttgcagactgtgcaggaggttgtttagggcacaagtcatttctcccaatattaacttataggcagtctccaaaacaggaatattcttcaagctgagcattgcttgataaacagcatgggctacagcaacaacctgaaaaacaaaaaattcaaggaagtgataaatggaaaataaatcttctaaaattatatggaaaataaatcactatctgtattagtgctgatgatacaaataaatttaagattgatcaattcactgtccgtagcacttaatattttaatttttaaaaaaccaatcagaaaactgacacagatcagtatgctatttcaaatctattaagttttatcacaaataaagagtactataaatgaaaactgtcaataggaaatttccaaaatggccgtttttttttaaataatcaacatcaaaagacatatgcaaacagcaatttaagactgggtttcttaaatctaccaggaaagtctgtggtggatttgactagggggtggttgaaaagccagtcatttttgtttacaaaatatacagtacttaatttataactttataaatgtgtcaacttgttttacccttatgaaaatttaataaatttaataacagcaagagatgcatagtctgaaaagagtatctggcacatcattcatgaaagtattcagtatgattatcaagaaatataaatttaaaagaacaaatacaatcactatattctaaatcaaacatttcacatttcactcaatttcacttatatagcctggtaagcaacattaggtccaactcttcagtgactcaagttgtcaaaattcattatcagtgtattacttacctctttttctttatgataacgcaagaatagtagtttagatgatggtataaacagtttttctacaaatgatgatggcagtttcgtatttatctgttcaacaatctaaaagaataaaatttttaaaaaatgagcttctcaaattacaaaaagacatggagaaaccttaaatgcacactggtaagtgaaagaagtcaattgaaaaggctacatactatatgactccaactacatggcattctggaaaaggcaaaacgatggagacagtaaaaagatcaggggttgccatgggcttaagatggagggagggaggagtgaggagagggaacgaggaaggagtgggtagaacatcaaagatttttagggaagtgaaactatcctgtatgatactggtaataggggatacatgtcattacacatgttaaagtccatagaatacataacacaaagtaaactataaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacgtattttacagttatcatgggcattttttcacattagcaaagagaggtgtaattctggcagaaatgctcagcagaatgtcatctagaatttgctttaaaataatccagctggagatgaaaggatagcaaagaggcctagatgaaaccagatgggccatttgtttctaattatagaagctgagtgttaaatatgtacaaatttattatactatgctccctatttttatgtgcttcagaatgtccataataaaagtggggggaggatatttatggttaagaaattaaaggaggccggccgggcgtggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcaaaagagcgagactccgtctcaaaaaaaaaaaaaaaaaaaaaaaaagaaattaaaggaggccaggcatgattgctcacacctgtaatcccagcacttcgggagggcaaggcaggaggattacttgagaccaagaatttaaggccagtctagacaatgtagtgagaccccttctctccaaaaactacaaaggttagccaggcatggtggcatgcatctgtagtcccagatagtcgggaggctgagtgggagaatcacttgagcccaggagtttgaggctgcagtgagctctgattgtaccgctgcactccagccaggggaatacagcaagatcctgtgacaaaaaaaaaaaaaaaaagaaaaaagaaaaaaagaaagaaaagaaaagaaaagaaaagcaaaaaagaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggattgcttgagcccaagaattcaagaccagcctgggcaacatggcaaaactccatctctacaaaataatataaaaaattagccaggtgtggtggtgcacgcctgtagtcctagctacctggggggctgaggtgggagggtcacctgaacccaagaggtcaaggctacagtgagccaaaatcatgccactgcacttcatcctgtgcaacagagtgagaccctgtctcaaaaaaaaattgcattaaaaataaaagtaaatagacactaaaatgaaagcatagattataagactgatgaatgtactctaaaaaataatataataaagcaaagcccttattttttttcttttttggagacagggccttttttgtcaccttggctgagtgcagtggcacaatcagagctcacttcaacctcaagttcctgggcttaatcgatcttcctccctcagcctcccgagtagctaggactgcaggtgcacaccactacaccaagctaatttttgactttttgtacagatggggtctcactacattgcccaagctgtgccagaattcctggatgcaagcaatccttctgctttggcctcccaaagtgctgggattacaagcatgagccaccatacccagacaaagtccttaatttcttacatatcgatttaagggcctgaataaaccaacacattaaaaaggaaaagaataattcacataccagcgtgagtaaattcaagactgagatgatataatcggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaacctgtaaatggggaaaacaagcagctttttacaaaaattcacgtgcttccacaaagcaagaaaatactttttatttaatgcaatttcaactgaaaattaactgcttgccttgccagcagtctcttaatattctagttctcagtagctgaataataatgatccctttactacaatatgtaaacatgatcttggctaaaaaatcctaaagtgctactatgacaggaaatggaacctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaagtttctatctactgatggtctcttttgaaagataagcactctcatgcttaccacataatatcttcaaaaatcatattatttccaatacacacacaaacaaaatcccccacttaactataatggccaataattgtgtactaaatttctaataaaatgggggagaaaacagagcaaatgtttaaaaatatttctataatatttaacaaccaatacatacaggattttatttagtctacccatagttttcattaaaagtatccttggaggttgggcatagtgactcacatctatcatcctagcactttgagaggattagctggaaggttctcttgagtccaggagtttgagaccagccatgtcaacataacaacacctcatctctaccaaatttgtttttaaattagttgggcgtggtggctcacaccagtagtcccaccaactacttgaggctgaggtgggaggatcacttaagcctgggaggtcaaggctgcagtgagccaagatcgtgccactgcactccagcctgggcaacagagaccatgtctccaaaaaaaaaaagagtgggggagagagggcggagggggaaccattcttggccatgcatgcacagtggctcatgtctataatcccaacactttgggaggctgaggtgggaagactgcttgaggccaaaagttcaagaccagcctgggaaacactgagaccccatctctacaaaaataaaaaattagcaggaactatggtgggaggatcacttgagcccaagatacagaggctgcactgagtcgtgatggcaccaccccactttaaaaagaaaaacaaaaaaagctgggtatggtgacacccgcttgtagggctgagtgaatgggaagttcacctgggcccaagagttcaagactacagtgagctatgattgcactactacactccagcctgggtgacagagtgaggctccagctccaaaaataaataaaaaaaataaaaaccccaccattctaccattctcaaaggcctaaaagatcctcataaatcaatatacacctatcctataaattatgtcccttttattttatgtctgaattaacggctttttatttcaactctgtacagtcttcaaccaccttttagacattaaaaatgaagcaaagatattaaaccattttgaaaccatattggtttaaaataccaatatgctggtttcatttatctttaagttctgacatttctgctcaagtacacaacttactatataatcaatatcctattttatttagcaacatgttcagcaaaagtatatgctcctaaaagcgagttttatcctaacagtaaaattttcatcagttagattaatttttttatgactgtatcacacatgcttctttctccttattcaaagcagagtacaatgcctggggttcatttcttgtgtcttttccactgaaccctcattggatgtgctatatacagtgcagctaatgtttgaggctgctgaagtgtggcaatctagctacctcatttttaatttgtttatgttctttgatatcaggctatcaaagaatataaagatatacaagttttcatatgagttccatcttatgctcagagaaggttactttctgaggcttctcctatagtgtgctattcgtaatatgttgaaaaactaaaaggaaacccaataatttaaaagtaaaattataagaaatattatttcttataataataccggcgcaggagggcagcaccagaggccagtggcactcccagctcggtgagagggctgggaagccagggaataaaactgggagggtggggtggggctggtgtttggggcacctcaaactcacaacattgggaatctttgtgggtccgggaatggtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtacctcccagactctgatgactggtcccctagacacgcagtttgctgaaccaaccagccctagagcttcccctccaccgcgctgaggggactgacccatggcaggggatgtgggatgccccctgacttactacatcacaggaacagggccttcgtgggtagaaaccagccatgctgatgtgggccaggaggctgctctccgtttccgagctccttctcagagctgacacagctgaactatttaaggccctagcttagaacctcaataattcccaaatttaccaaaaatctgcctttcctagtcaaccaaaacatcacgttgcacgtgactctgctggcactgttgcttgtgaggaaatgaaccaaccatcacttacagggtaggcatcttttaaactgcaggtccaaagataaaaataacgagggaggctgggcatggggactcacgtctataatcccagcactgtgggaggctgaggcggcaggatcatttgagcccaggagtttgagacctgcctgagcaacacggcgagataccgtctctacgaaaaataaaataaaaaattagccaggcatggtggtgggcacctatagttccagctactcaggaggctgaggcaggaggatcccttgagcccaggaggtcgaggctgcaatgagccattgcaccactgcactgcagcctgggtgacagagcaagacactgtctctaaaaaatataaataggccgggtgtggcagctcacgcctgtaatcccagcactttaggaggccgaggtgggtgaatcacctgaggtcagaagttcgagaccagcctggccaacatggtgaaaccccatctctactaaaaatacaaaaattagctgggcatggtggcaggcgcctgtaatctcagctactcaggaggctgaggcaagagaattgcttgaatccgggaggcaaaggttgcagtgagccgagatcatgccattgtactccagcctgggggacaggagtgagacttcgtctcaaaaaaaaaaaaaaaaaaaatatatatatatatatatttttttttttttaaatgtataaatacatcatatatattttaatatataaatatattatatatattatatattttaatatataaatatattatatataatatattttaatatataaatattatatatattatattttaatatataaatattatatatattaattatatattttaatatataatatatattatattatataataataaattatatattatattatatagtaataagttatatattatactatataataatatagtataatatataatatatattataatatattatattatattatattatatattataatataaattatatatattttatatatatgttttatatattatatattttaatatatgaaacaggggaacttcttctaaggaaaagacagaattaaggcaacaggctgatcctagtttaccagagaagaaactgaggccgggagcaggagcccagctcactgaagggcagatcccaagtcagagtccaagtctccccacttttttatttatttaattttttctgagatggagtttcattcttgttgcccaaattgagtacaatggcacaatctcggctcaccgcaacctctgccttctgggttcaagccattctcgtgcctcagactcccaagtagctgggattacaggcatgtgccaccacgtccggctaacttttgtgttttcagtagaggtggggtctcaccatgttggccagactggtctcaaactcctggcctcaagtcatctgcctgcctcagcctcccaaagtgctgggattacaggcatgagccgctgtgcctggccttatgtctccccttttgaattcagagccttcccccgtgtagtgagtgcttctgcctctctagcccttcctgtgggttctgcctgggcctgacctctgtgagagacctggcaggaacaggtctgtcaggccttgtggggagtgggtgtgggaataggttttgatacccaacttagcaggtgatcctgagatgggaggacacagggctgtttgggatgggcgtcttagccatagtaaggtttggttcatatcaagcagggaccacccatggcgtcatttccaggccccacctcttcagtatgccatagaaaactacttgggcagtagaggtgtgggaagaaaacaaaaaagaaagctgggcataagtggcacacgcctgtaatcccagcacttttggaggccgaggcgggtggatcacctgaggtcgggagttcaagaccagcctgaacaacatggagaaaccctgtctctattaaaaatacaagattagccgggcgtggtagcacatacctgtaatcccagctacttgggaggctgagacaagagaatcgcttgaacccaggaggcggaggttgtggtgagccgagatcgtgccattgcactccagcctgggcaacaagagtgaaactctgtctcaaaaacagacaaacaaacaaacaataaaaaaaccccaaaaattagctgggcatggtggcgtgtgcctgtaatcccagctactagggaggctgaggcaggagaatcgcttgaacccgggagggggaagttgtagtgagccaagatcatgctactgcactccagcctgggcaacagagccaagactctgtctcaaaacaaacaaacaaacaaacaaaaaaacgcaggaaaagagtgtgtgatggctgaaacttgcaatttctcactctcaacgagccctggccccaactaggttatttgggctccctccctaggtctcagggacctctgttcaaagtcctagcaatctgggccaggtacaatggctcacgcctaaaattccagcactttaggagaccaaggcgggcagatcacttgaggccaggagtttgagactggcctggccaacatggtgaaaccctgtctctactaaaagtacaaaaattagccgggcatggtggtgcacccctgtaatcccagctactcaggaggctgaagcacaagaatcttttgaacctgggaggcagaggttgcaatgagctgagatggcgccacggcactccagcctgggcgacagagcaagaccctgtctcaaacaacaaaaaacaaataaaacaaacaaggtcctagcaaccctactaacctgttatgaagactgatacaggggcatcacctgccccaattttctgactcaggtcagccttatattcctactctaatctcacccctatccccgtcccacacccactattcttaaaacctccatggtcctccgggggcagctgtagacacattaagcccagggctatggggccactggaaccttctccagtgggtctgaaaacatcagcattccaggagttgatgagcccctacctgggcaccactccctcttgggcctgagaaggccggggggaacctgcaaggaatatgtggaattctatatggtgcctctgatactgcggtaatgtcagggagaggtttgttcaactggtcagggccctgaaaccccgatcactttctcatctctgcatcttgaaggctagcagagaggaggaaccctgagctctctaggaggtgggtaggtggtggcagtacagactcctagatgtctaaacggagttgcagagagaaggctttctcggtagaccctggaagggacttttacggtagaactttcattttacaagcagggatagaggcctagatggggacagagacgtgtccaaggtaaaacaatggacggaggcagggcagggagaggccaggtcctagactcggcctcagcacccctcccacacacacatcgacacagaagctggtccagatttataatttaatggctgtgcagatcccagtccctcatttctgtcgctcacgtgcccactggtctggggtcagggttttctgttcaaaggcatggatgtgcgggagctcttctgctaggcacgcgttcaccagcctggggcgagagatggggttaggaaaaggccagcggtgatcgcacaccccgaggctagggtgacccaagagactggtgtccccaaggttgtagtccccaggccgtgggaacacgtacttggagagagggtctacatcgaaatactcgaagcaggggtcacgaaggcgggatcctcaaggtccctgagccacgccagggggagtgcgggagtcaggttgcaggggtagggggagtggctggggttgtggtacaggagctaggcaaggtgctcccagggccttacctgtgtctctgaagcagcggtttcccctcgaacttggccgacaccaccaggactcggaagctacaggagcaacggttgagggtcgtgtcctccacctcctaccgagcggaagaatatgaatggtgccgaacccgccccccgagctcttttccccttgtccggcggctcaactcaccacatgctccgcctccaggtcccgctgcagcttctcgcggaggtattcggcgctgagttccatggcggcagtccagctggaacggcagcccagcagggacacaaccccagctcgggcgccggccacgctaccttgctgccttacaggagccacttccgctggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctggtgagagggggaggccttctgtgccgggaggaaggcgtcccagaggaggcggaccccgcggggcacaggcctgttgagaaggaccggccaggactgtgacagaggcggggcgtctgtggtggggacggggcctgtcgcaggggaggagcgtgacggggaggcggtgcccggggcatctccgcggcggaactcagggaaggagctagctggggcgggggtgatgatccaggctgggttccagcatagggctcttggtgggcacgctggggtcgggtggaatgcaggagagagaggaggtgggacaggtgggtacctgggctggaggcagggcctgaggtgggcaggtgcagagggctgcacttctcggctgaagccgggaatgaggaccccgctctcgggtgggattggaggggacccgcggctgaggcgctgggctgcgacagggacatcacggttctcctcctcagggagatggtgctcgtcgtgcacggcttcccgtcctccgtggccgcccttcgggtaaggaaggagaccgggcagcggcggccgggtgagggcttgggttccgcccctcgctccgagccgccctgatgcccctgtacgccgcccgcagtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggtgaggtccccccgaggaatggatggctctagagtccagacgacttcggatccagctctttcttgagggaaacccactgacacgctttggccaccctatccccatctctaagatgctgatgctataggacttacggccattcctgagcaaagcaggccctgctcagggccttcaccatttccccttcaaagaaaaggttcttccctaggccatcagtactccgctgcactccagtgtggtcgacagagcatgaccctcttttttttttttttttttttgagatggagtctagctctgtcgcccaggctagagtgcagtggcgcgatctctgctcactgcaagctccgcctcctgggttcacgccattctcctgcctcagcctcccgagtagctgggactacaggcgcccgccaccacgcctggttaattttttgtatttttagtagagacggggtttcaccgtgttagccaggatggtctcgatgtcctagcctcgtgatccgcccgcctcagcctcccaaagtgctgggattacaggcatgagccaccgcgcccggccctttttttttttttagacagagtcttgctctgttgcggaggctggagtgcagtgatctcagctcactggaagctccgcctcctgggttcaagcgattctcctatctcaacctcccaagtgtgccaccacacctgccgaatgtttgtgtttttagtagggatggggttcgccatgttgggcaggctggtctcaaactcctgacctcaagtgatctgcccgcctcggcctcccagagtgctgggattataggcgtgagccaccatgcctggacatgaccctgtctctaaaacaatgtaatgaactgcagctcattcttgtgtgcacttttctgcaccccctttcccttaacacttactattgtctggcatgctacgtgttttcttgatctcattagcctctcccaccccaactgccacactgcactatcagagggcagcacttatcactgctgtagaacaaagtcctgcactgagccgatggcccagaaattttctttttatttatttatttattttttttttgagacagagtcttactctgtcgctcaggctggagtgtagtggcgcgatctcagctcactgcaacctctgcctcctggtttcaagcaattctccttcctcagcctccagagtagctgggattacacgcgcctgccaccgcgcctggctaatttttgtatttttagtagagatggggtttcaaccatgttggccaggctggtctcaaactcctgacctcaggtgatcctgcccacctaagcctcccaaaatgctggtattacaggcatgagccaccgtgcccggcctaaatatttaataaaataatggacgatgggtgccttctactgagctcccggtaattgtgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcctgctgcatagaggggttgctgccagctgcctctccctccttgtctcttacctgcctgctgcctgggtcaggatgaagaggggcccttgtgttgcccccaccctggctgcctgctaagggcccatgtgatctgcctggcagaggagtttcttcaggaagaaccagggcagcttctgcccctagagggccaatgcccttggtgagtgcagtcccctggccccagcctggtccacctctgggaagagggtgcccagttgtgcaatccaggcccaggcagctgagccctcatctcagcatccagggcggatactggagggggcttgtggcatctgactctgtatctcctacctgcccctctccttggtagctgtgagaagtcactgctttggggagacctgatctggctgtgccagatggacactgagaaagaagtagaagactcagaattagaagaggtgagtgggctttggtggcgggctccctaccccactccctgccctgggctgcctgtgaccacactgcttgcctctgcaggcacactggacagacctgctggagacctgatcctcagtgtccttaccccctcctacctcttttctgtgccacctgctgtgggtccagcaggtttttacttgagtacaataaaaagtctgagtcaagggtgccttatggtggatgctgaggggaggggcggagctagtagcccaaggtcctgccagtcacggggcttcctcaggggcacagaggaggcaggaggggcccctggccctagcacgtgaacagcttctactctgcctggaaaccccatgcctcagctttcccctacttgcctctgagctcatgcaattcttggaagcctgggagacttaccttgaaattgaatgcaaataggacaaagaccaaggaggatggggggatgccctccttccacggggccctgtggcttccaagtcttaatctcctctagtctcttgtctacggagcctccttcaaacccagggaaagaaaagcacctgccagggttgtttttcttctaggatcttctattgatgctctgtgaggtcccccaggagccatgaagctagggctggctcctagggcaatgggactacagtgtccttgtcctttcttattctttctgttctttctttctttctttttttttttttttttttttttttgagacagagtctcactctgttgcccaggctggagtgcagtggtgtgatcttggctcactgaaacctccgcctcctgggttcaagtgattctcttgcctcagcctcctgagtagctaggattacaggtgcccgccatcatgcccagctaatttttgtatttttagtagagacagggtttcaccatgttggccagcttggtctcgaactcctgacctcaggtgatcctgctgcatcgacctcccaaagtactgggattacaggcgtgagccaccacgctcagcctctttcttgttctatatgtccatgctctgctccacttctgccccttcactctgcccccacacatcactccagactggccttgtggtcagagcctggaatgcctgggctgctgggggcctgtggactgcactgggccagaacccctgccgccttcaagactggcctgtagccagcaggtaggtgacttttcccaggccggcctatcccacctttcccctccactcactcacctcccttgcctgggtcaattagagaaagcttgtcggccaggcatggtggctcatgcctgtaatctcagcactttgggaggccgaggcgggcggatcatctgagctcaggagtttgagaccagcctggccaacatggcaaaaccccgtctctactaaaaatacaaaaattaaccggatgtggtggtgtgcacctgtaatcccagctactcgggaggctgaggcagaagaatcgcttgaacccaggagggggaggttacagtgagcggagatcgtgctactgcattgcagcctgggcgagagagcgagtctccatctcatataaaaaaaagaaaaagaaagaaagaaagcttgtctgttggcctgccctgcagggtggagttcagagggaaggtcaggagcctagtgacagctcaaaaaaaaaaaaacccaaataccaatgttggccccttttgcctttcattcatgtgttttctatacactaaactcacatattgggtttgcagatcactccaagcttggctggagctgtggtggtaaggagggtaatagagaagcttccccaccctcaaccccaccccttccttcctggagttcccagccctgactttagatccctcccacactggaccttcaaaaccctcagggcagagagcagccctacactccctacaccacacccatactcagcccctgcaggcaaggagagaacaggtcaggttcccgagagctcaggtgagtgacacgttggaatggcccagggcaccttcaccctgctcagcttgtggctccaacattctagaagccgaggcctctgccatccctgccctttcccatggatattccatttcaattagacaacccagcctggccggaatccccctgcgttccttcttttcctttgtgtatttttgagacagggtgttgctccgtcacccaggctggagtgtagtgggatcctggcccactgcagcctcaaattcctaggctgaggcaatcctgccgcctcagcctcctgagtagctggggttacaagagcaagccaccacacccagctaattttgaaaaatattttttgtagaggagaggtcttgctttgttgtccaggttggtctcaaactccagggctcaagggatcctttcccgttggcctcccaaggctctgggattacaggcgggagtcaccctgcctgggcccctccttttgatgagtcatcagttttcattcccgcacgaggctctagcccctggtaccagcttagttgctcaatgggctgtgtttgttctggagcccagatggactgtggccaggcaagtggatcacagacctggccggcctgggaggtttccacatgtgaggggcatgaggggggctcaaggaggggagcatcggggagaggagcgcactgggtggaggctgggggtcccagcaggaaatggtgagacaaagggcgctggctggcagggagacagcacaggcaggccctagagcttcctcagcacagctggactctcctggagaccttcacacaccctgatatctgggccccgcgctacgagggtgctttcactggtctgcactatgccccaggccctgggattttgaacagctctgcaggtgactgaaaggtgcggccaggctggggaacgacctggtttcagccccagccccgccactgactgactttgtgagtgcgggcaagtcactcagcctccctaggcctcagtgacttccctgaaagcaaaaactctgcaaaggggcagctgggtgctggctcacacctgtaatcccagcactttgggaggctgaggtagacaaatcacttgaggccaggagttctagaccagcctggccaacatggtgaaaccccatctctactaaagaaaaaaaaaaattagctgagcatggttgtacatgcttgtaatcccagctacttgggatgccgaggcgggaggattgcttgaacccaagaggtggagtttgcagtgagctgagattgtgccacactgcactccagcttgggtgagagtgagactccatctcaaaaaaaaaaaaaaaaagagagaatcccactttcttgctgttgtgatggtggtaagggaacgggcctggctctggcccctgatgcaggaacatggagctgatccaggacacctcccgcccgccactggagtacgtgaagggggtcccgctcatcaagtactttgcagaggcactggggcccctgcagagcttccaagcccgacctgatgacctgctcatcaacacctaccccaagtctggtaagtgaggagggccacccaccctctcccaggcggcagtccccaccttggtcagcaaggtcgtgccctcagcctgctcacctcctatctccctccctctccaggcaccacctgggtgagccagatactggacatgatctaccagggcggcgacctagagaagtgtaaccgggctcccatctacgtacgggtgcccttccttgaggtcaatgatccaggggaaccctcaggtgcatggctgggtcctgggggtaagggaagtggaggaagacagggctggggcttcagctcaccagaccttccctgacccactactcagggctggagactctgaaagacacaccgcccccacggctcatcaagtcacacctgcccctggctctgctccctcagactctgttggatcagaaggtcaaggtgaggccgggctcaatggttcacacctgtcatcccagtttgagactgaggagggaggatcccttgaaggcgagagatggagaccagcctgggcaacattgctgtagagatgacatcccatctctacaaaaataaaattaacaacctggtatggtggcatagactgttcccagttacttaggaggctcagcggggaggactgtttatgcaaataggaagctgcaatgagccctgatgatcctgctgctgcactccagcctgggcaacacagcaaaaccatctctacgaaaaaaaagttcccactgactggcaaggaaagccaggaaggggggctcaggtgccctctcagccatgtacctgttcttctggaagggcctcctcgcttctgccaggctcatcacatcttttttttttttgagacagagtcttgctctgtcaccctggctggagtgcagtggcatgatctcagctcactgcaacctccgcctccccagttcaagtgattctcctgcctcagcctcctgagtagctgggattacaggcgtgtgctaccacacccggctaatttttgtattctttttagtagagacggggtttcaccatgttggtcaagtggatctcaaactcttgaccttgtgatcctcctgcctcgacctcacaaagtgctggaattacaggcgtgagccaccgcgcctggccctttttttttttgagacagtttcactcttgttgccgaggctagagcgcaatcgtgtgatctcggttcactgcaaccaccgcctcctgggttcaagcaattctcctgcttcagcctcccaaggagctgggattacaggtacctgccaccacgcccggctaattttgtatttttagtagagatggggtttcaccatgttggtcaggctggtcttgaactcctgacctcaggtgatctggccaccttggcctcccaaagtgccgggattagaggcatgagccaccacgcccagccttcatcacatcttgagagaggacactgtctgcctcttgctctgatgagggtctgatgcaaggatagtgagtctctacagtgcacacttaagaaaggcagcatgtgggtgctcacaggtcagcggaggagggggagctggtggggaccaggcatgccttgctccagatcaggatatgatggcattggtgcagattatattagtatagaatatggtctcaggaaccaggcaggactttggcttccgagcagggttcagatcccagcttggccctacctgtgcagtgagatctcaagcaagtcagcctctaagcctcaggttcctcctttgccagttcaacagatgagctggcctggggtgggctgtgtggtgatggtgctggggctgggtcctctgcccctgcaggtggtctatgttgcccgaaacccaaaggacgtggcggtctcctactaccatttccaccgtatggaaaaggcgcaccctgagcctgggacctgggacagcttcctggaaaagttcatggctggagaaggtgggcttgactggaggaaggagggtgtgaagccgaggggtggtggctataacgtacagcaaccctgtgtcggtgccccctgcccgcttctctagtgtcctacgggtcctggtaccagcacgtgcaggagtggtgggagctgagccgcacccaccctgttctctacctcttctatgaagacatgaaggaggtgagaccgactgtgatgcttccccccatgtgacacctgggggcaggcacctcacagggacccaccaaggccacccagccccgtccctgggcggctcccacagcaagcccggattccccatcctacctccctggcccaggcccccccactgcagccccacctggcagcaggctcggcacagctttcatcttctgcacctgagtcagctgcatgggtggccacggatcagatacttagtcctattgcttatcctcaccaaagggtgtgccacccagggccacagtcatggaagaagaccatcccggtcctcacccataggcgccaagccctgttcatgatgggatcacagggcagagatcaattcattttactccagagactagggccccaggggttgaggctctttggggtttctaggggaagtggccagatcccctctgaggttagagagggggacccgttttgttttgctccactgaggagccctctgctgctcagaaccccaaaagggagattcaaaagatcctggagtttgtggggcgctccctgccagaggagaccatggacttcatggttcagcacacgtcgttcaaggagatgaagaagaaccctatgaccaactacaccaccgtcccccaggagctcatggaccacagcatctcccccttcatgaggaaaggtgggtgctggccagcacgggggtttggggcgggtgggagcagcagctgcagcctccccataggcacttggggcctcccctgggatgagactccagctttgctccctgccttcctcccccaggcatggctggggactggaagaccaccttcaccgtggcgcagaatgagcgcttcgatgcggactatgcggagaagatggcaggctgcagcctcagcttccgctctgagctgtgagaggggctcctggagtcactgcagagggagtgtgcgaatctaccctgaccaatgggctcaagaataaagtatgatttttgagtcaggcacagtggctcatgtctgcaatcccagcgatttgggaggttgagctggtaggatcacaataggccacgaatttgagaccagcctggtaaaatagtgagacctcatctctacaaagatgtaaaaaaattagccacatgtgctggcacttacctgtagtcccagctacttgggaagcagaggctggaggatcatttcagcccaggaggttgtggatacagtgagttatgacatgcccattcactacagcctggatgacaagcaagaccctccctccaaagaaaataaagctcaaaataaaatatgatttgtgttcatgtagagcctgtattggaaaggaagagaaactctgagctgaaagagtgaatgcccggtggggccacatatggtcacctctcccccagccttcagctccccaggtcaccatatctggggaggggagaagggtttggagaagtaaaacccaggagatgtgtggaggggggatgtctgtttaatcccagcacatcctctgctgtcctgccccaagatggtggaggacgtcgagtccgccgggcagcgtcactttttcttgggctccttagaagctaccaggtacctctgggccacactgagatgaggggagtagccgtctgcataggaggtgtcttcaaacaggatagaatagtcctcctggggctgtggggcaggtggacaggaagggcagagagcagccccggggctggtgtcactcacttgttggtggcatggctgtaactgaccacctcggccaggatccactgctcatccccatccacggccttcacccgggcagccaccttgtctccaggtctggccacgtagtctcctgaggcagggatggccccacagaggggtgggggcctgtgagtggaacaaaggatcagtcccagcccctgggcaccagccccttcctcgcagctgctgccctcacttgtcaccaggcttcccaatccacaggggcagggtcatggccgactgctgcagcagggtcatcagcacccctctgcgcatggtcttccggggtggctccaagtcattgtagagacccgcgatcttggccactgtgggaagaaagggaggcctgaggccccagggacaggggctggccctgaccccccagcatgctgaactgagctgctggaggagcacctgggagcccccagctcccgagtgagcccgagggcacagcaggactgtgacctgatctgccaggtgtcctacaggggctgctgcgctcaactacatatgggtgagacggcagcacaccaggcacccaggggaaggaaccagggagggacaaagcgggttctgaggtgctggtgaggttctcttcttgatgtcggtgctgacacagaagtgtgtttcgttagtgaaaagttcctaaaattcgaagggtcccgcgggaatcggggcgaggccgggtgcctcttcagcgtccagctgctctactgcctgaatccctggtacccgggccctgtctacgtggggctcactgtcaaccctgttcgtccagcagcacaatggtggccgcaaaaaaggcggggcttggcggaccattggccgaggtccctgttaagagggggagggtctctgtgcccggaggaaggctccctggaggaggcggaaccggggggcacaagcctgctgagagggacccactaggtctgtgacgtgcgcgggacgtcccgggcgaggcctgttggtggggggaggctgtcgcaggggaggagcctaacggggaggcggtgccctgggaatctcggcgttagaactccggagagcagctggctgaggcgagggtgatgatccaggctggggtccagcgcaggggtcttggggggcacgctggggtcgggtggagcgcaggagggagaggaatgagaacaggtgggtacctgggctggaggcgggacctgaggtgggcaggtgcagggggcgtgccttcaggcagttgcggggccagggctcggctgaagctgggagtgaggaccccgttctccggtgggataggaggggacccgcgatgctgggctgcgctggcggtagggcgcggcggggctcacaggaacattcctgttgtcctccccatggagattgtgctcgtcgtgcacggcttcccatccgccgcggccgcccttcgggtaaagaagaagaccgggcggcggcctgtggcctggatttggggtccgacccccgcccggagccgccttgactccaaccccgccgcggttggagggggcctggcacccccgccctgggcgctcctcccggtcccgttgcgccccgacctccgtcagccgcacggcactggccactgaccgtcgggcctcctccgccccagggcgccgcgcaggtccctttgctgacgccgagcctgagcctgagccggtcccggggtccaagagggctgtgtgcaccctgcgcgtccgcgcgctccaggggaggtgcgctccaggggaggtccgccccaagcagagcggcacatcctccagacgacttcggatcctgctgttgaggagccaggaaacgccctgacactgttgcggccctgtccacatctctaagatggggatggatgatagtacttctggccattcctgagcacagcaggacctgccttttccctttgactggaaggttcttctctacatcttcagtcttgataacctgccacctccacagggaggtcttccctggctcccaatttaaaattgcagctctgagaagccgggcatggtggcatatgcctgtagtcccagctacgggggaggctgaggtgggaggatcgcttgagcccaggagttggaggctgaagtgagctatgatcactccattgcactccagcctgggggaaacagcaagaccctgtctctaaaaaaataaaatacaataaaattgcggctctttcttgtgcacttccctgcccgcccccctttcctgaacccttattattttctgccatactacaaattttatgcatctcattaaaccccttccgaacctgtgtactaaactgcctgggggcagctctcatcactgctgtagaacaaagtcccacatagagccaatggccaagaaacagttaataaaataacagacgatggtcctggcctctactgtgagtgagtaaagggcttgccctgcagagattcagtgatctggcgggggttgctgagctatgaggaagttcagatctggctgcaggggtgaggctgtgactcagtcaatcactgcccatgctcacaggacactggccagcttagtccctgggggcaaggattttacccccccccccccacctccatttcctcatctctaagatgtgaataatcgtcgcccctgcctcacaggattgagctgtgtaacccccctcccaccttttttctatgccatccactgcgggtctggggctttttactggaatgcaatacaaagtctgagtcaagggtgccttctgttggttgctgagggcggaggcagagctagttgcctgtggtcctgccagtcaaggggcttccagaggagggaggaggggcctgtggccctagcatgtgagcagcttctcctctgcctggaagccggacgcctcagcttctcccacactcccacctgcccgcttgcctctgaattcacacaattcttggaaggcttgggagactcacctttactcaaatggttacctgtctcgtgtctcgtgcccagcttgaccttttttttttttttttttttttttttgagttggagtcttgctgcgtcacccaggctagagtgcagtggcgtgatctcagctcactgcaatctccgcctcccgggttcaagcaattctcctgcctcagcctccccagtagctgggattacaggtgcccaccaccgtgcctggctaattttcgtatttttagtagagacagggtttcaccatgttggccaagctggtcttgaactcctgacctcgtgatctgcccaccttggcctcccaaagtgctgggattacaggcgtgagccaccatgcctggccccagcttgaccttgaactttaaatagtgaagacaaagaatgaggagggtggggggatgccctccttccacagggccctgtggcttccaagcctcaacctcctctggtctcttgtctgtggagcctccttcaaacccagggaaacaaaagcacctgccacgggctgctgtttttctaggatcttctagcgaagctctgtaacttcccctgagagccatgaaactgggctggctcccagggtgatgggactccagcgtctttgttctttcttgttctatgcatccatgctctgctccaccgctgccccttcaactctgcccacacatattactccagactggccctgtggtcagagcctggaatgcctgggctgctgggggcttgcatgcaggctgcactggactagaagcattggcgccttcaagactgccctgggaaacatgacctgccctgtttctgtctagtgagtacccatttttccccactcaccggctcacttcccttggctgggtcaattagaaaaagctcttctgttggcctgccctgcagggtggagttcagagggcagctcaagagcccggtgacagctcaaaaaataaaaaaagccgccaggagcagtggctaatgcctgtaatcccagcactttgggaggccgaggcaggcggatcacctgaggtcaggtgttcaagaccagcctgaccaacatggtgaaaccccgcctctactaaaaatacaaaaattagccgggtgtggtggcggatgcctgtaatcccagctactcaagaggctgaggcaggagaattgcttgaacccaggaggtggaggttacagtgagccgagatcctgccactgtactccagcctgggcgacagatcacgactccatctcaaaataaataaataaataaattatacattgggctcttttgccttttattcttgtgctttctaatcacaactaaacactaaactcacatcttggctttgcagatcactctaagcttggctgcagctgtggtgctgaggaggctaatagagaagctccctcgctctcaaccccaccccttccttccgggagcaaacccaagtctggtcccgactccggatccctcccacattagacctaccacaccctcagggcagacaacagctccacacaccccacactcagccaccagggcaagggagcaaaattccagaaagctcaggtgagtaccagagtggaatggcccagggcgccctcaccctgctcagcttttggagccaacattccagcagccaaggcctctgccatactggctgtttccccacggatatccagtttcactaggggaactccagcctggcttcccttctttcttttttatttttgtttttttgagacaaggcttggctctgacacccaggctggagtgcagtggccaaattgtagctcactgcagcctcaaaatcatgggctcacatgataatcacgcctcagcttccctggtagctgggtgtacaggagagagccaccatgcccagctaattttttaaacttatttttaatttattttttatttttttgagacggagttttgctcgtgttgcccaggctggagtgcaatggcatgatacagctcactgcaacctccgcctcctgggttcaagcgactctcctgccttagtctcccaaggagctgggattagaggcatgcgctatcacaccctgctaattttgtatttttcatagagaaggggtttctccatgttggtcaggctggtcttgaactcccgacctcaggtgatccgccccaccttggcctcccaaaatgctgcgattacaggtgtgagccaccacacctggctgcccagctcagttttaaatattttttttctagagatggggtcttgctgtattgcccaggttggtctcaaagtccaaggctcaagtgattcttccccactgggcctccaaagctctgggattacaggcatgagccatggtgtcccctcctcattctgcggaatcatcagagttttgttcattcccacaccaggctctggcccccagtaccagctcagttgctcaatggaccatgcttgtcctggagcccagatggactgtggctgggcaggtggatcacaggcctggccggcctgggaggtttccacatgtgaggggcctgaggggctcaaggaggggagcatcggggagaggagcccactgggtggaggctgggggtcacagcagaaaatggtgagacaaagggtgctggctggcagggagacagcacaggcaggccctagagcttcctctgtgggcggcaagccacccaggcaccgaggcaagagacagaggacacgatctgttccagtataataaaatataaaacaagaatagttataccagatatagatcttagatatgattatatatgaatatcattaatcattagtttgtagcaattactttttcttccaatattataataatccttgctctataatcatagcctaggaaaaaccaggccatacagagacaggagctgaagggacatagtgaggtgtgactgcaagacaggagtgcgagccttctgttatgcccggacagggccaccagagggctccttggtctagcggtgacgccagcgtctgggaagacgcccgttaccaggcggatcgtggtccagcggtagcaaaaggtgtcaagaaacaacacccgctactcagcagaccaggaaaggggggtctccctttccctgggggagtttagagaagactctgctcctccacctcttgtggagggcctgacattagtcaggctcgcccgcagttatccggaggcctaaccgtctccctgtgatgctgtgcttcagtggtcacactcctagtccaccttcatgttccatcctgtacacctggctctgccttctagatagcagtggtaaattagtgaaaatactaatagtccctgatatgcagaaataatggcataagctgtctttctctttgtctcctctccctctctgcctcggctgccaggcagggaagggccccctgtccggtggacacatgacccacgtgaccttacctatcattggaggtgactcacattctttaccctgccccttctgccttgtatccaataaataacagcgcagcccgacattcggggccactaccagtctctgcacattggtggtagtggtcccccgggcccagttgccttttctcttgtctctttgtcttgtgtctttatttctacactctctcattgccgcacttagggagagacccaccgaccctgtggggctggtccctacagagaatgacttgaacctgggaggcagagattgtagtgaggtgagattgcaccactgcactccagcttgggtgacagagcaagactctgtctcaaaaaaaagatgaggtgagttcagtttgggaaatgttgaatgccagatgcctttggcctattcagagggagattgccgaagcacagaggagagttcatgacagggtttaattatttttagtgctctcatgtcccagattcggccaattggagtccctccacgctggttcctgtgtcctgtgacatcacccatcttctttctccttttcttctttcataagccacttccttcctggcatgacagtgtgttccaggaccatcttgtaccttgcacctgccctgccctggccctagaatcagccaattctctgaggcatcctgattcctttttgtgggggaacggtttgagaacaaaatatactactacatgatactatattctgacaggaaaaaacacagccataagaaataaagccatggccgggcacagtggctcctgtaatcctaacactttgggaggctgaggcaggaggattgcttggggccaggagttcaagaccaacctggcccacatagtgagccctcatctctattaagaaaaaaaaaaaagaaagaaggaaagccatatttggatgagtttagtcttctgattatttttgctgaagttttaaattattattattattattttttgagacagagtctcgttctgttgcccgggttggggtgcaatggtgcagtctcagctcactgcaacctctgcctcccaggttcaagcaattctcctgcctcagcctcttgagtagctgggattacagattcctgccatcacgccctgctaatttttgtatttttgttagagatggggtttctcaatgttggtcaggctggtctcaaactcccgacttcaggtgatccggctgccttggcctcccaaagtgctgggattacaggggtatattttatatttaaagtatatttaaaaattaagggccaggctcagtgtctcacgcctgtaatcccagcactttgggaggccgaggtggctggatcccatgaactcgggaatttgaaaggcacaagagcgaaactccgtctcaaaaatatatgtaaaatatattttatggccaggcatggtggctcacaaccgtaatcccagcaccttgggaggccgaggtgggcagatcacctgaggtcaggagttcaagaccagcctggccaatatcgtgaaacgctgtctctactaaaaatacaaaaaattaactgggcgtggtcgtgtgcacctgtaatcccagctgctcagaggctgaggcaggacaatcccttgaacccgggaagtggaggttgcagtgagccgagatcgcaccattgcactccagcctgggcaacaagagcgaaactccacctcaaaaacaaaacaaaataaaacaaaacaaaacaaaacaaaatatatgtatatacacacacacattatatgtaatatctacttttaaatataaacataaatattataaagcttttattgcaattgttcattttagaaacttcagaaaatacaaattagtaaaaagaagaaaataagtctgtaataccacttttaagaactattttaaaaacctctagcttttttttgagatataatttacataccaagacttttttaaaaaaaaaaattcataatggtgacttttttatcggactgtatagaataaagcttgttaaaatgtctaagatattttgtaatatatgaaaatttcagctaaacttgtgctatagcatcccatggtttgaatatattattgaaaatcattccataaacaatggtttggtatatagttttaacaattcaaggctgggcacaatggctcacgcctgtaatcccaccactttgggaggaggaggcaggcaaatcacctgaggtcaggacttcaagaccagcctggccaacatggtgaaaccctgtctctaataaaaatacaaaaattagccgagcatggtggcaggtgcctgtgatcccagctactgaggaggctgaggcaggagaatcacttgaacctaggaggcagaggttgcagtgagccgagatcttgccactgcactccagcttaggcgacagaatgagactccatctcaaacaaaataaataaataaaataattcagcaggatgaggtggctcatgcctataaccccagcactttgggaggctgcggtgggactattgcttttgcctgggagttcaagaccagcctgggcaacatagagataccatgtctcagaaaatatatatataattaattttaaaaaagagaattcattgatgattctgtatttacaaatatattcctgcatcatttgttcatggtaaccaggaaattgcaatgcataaatacatgctgtcatttccaaagcggctctcttccagaattggtactgattctagtagacttttcattctgatgttaaaaatataattaatagaaatgtcttgtacctaatagcttttttccccacaactccccaaccccctcactctagaggccttagtagtctaatttaatcagcttagtctgaaatataatactaccttggcatcttgttggcctagtatttcttactcttttatggaatgaactgtgcaattgttttgtgtggctaaaaggtattctaggtcgagtatagtggctcacacctgtaatcccagcgctttgggatgccgaggtgggcggatcacctgaggtcgggagttcgagaccagcctggccaacatgttgaaaacccgtctctactaaaaatacaaaatttagccaggtgaggtggtgtgcatctgtcatcgcagatactcaggaggcagaggcacgacaattgcttgaacccaggaggcagaggttacggtgagctaagattgcatcactgcactccagtctgggcaacagagtgagaccctgtctcaaaaaataaaaaacaaaataaataaataaaaaataaaaggcattctaattaagttgttgcttttttttttttttttaattccagagcggactgatgtactggcccttagtacaggtgagttccgcctgctcagtaatatgaactcagggctttggtttccatgtggccctaatggactcactctccctgttccagctaaccaacttcagccttgttcctgttcaatggagaacagcttacgctggagtctgtggttttctctgggccaccttcatctgtttttcccagcagagcggtgacggcacattcaagtcagctttcaccattttatatacaaaggggaccagtgccacagaagggtccccggagaaatgagaagtcaaggactctcttaaagggaccacattttgacctaaaatgcacagaattgcctgcagacaaaatatttgatgtgccaattatgcacttcattttgaggaattactactatttatagacccacttttaaaaaaattatcaatgattattttttaattgtattcagacattttttcctgatctagtctgaaatattacttctctaatattttggttaatatgaataacagtggcaaaatggcattttagaattattaatatttctaatattttaatgcaagtttcaggaaacttggtttcttggttttgattgtttacatttctattctaaaatctcaggttatctcctgaacacttttggacagatgaagttttacaccaaaaaatagttcttagagtgaattttaatttacatagaactcaatcgaaatgaagatttaataaccagatttctttccccaaaacatacataatttgttattttgatactaaaatttagtaaatacctttttttttttttttttgagatggagtctggctctgtcacccaggctggagtgcagtggtgccatcttggctctctgcaacctctgcctcctgggttcaagcgattctcctgcctcagcctcccaagtagctaggactacagtcgcccagcaccacgcccagctaactggtggtggtagagacagggttttaccatgttggccaggctggtctccagctcctgacctcgtgatccgccctcctcagcctccgaaagtgctgggattacagcagtcagccactgcgtcctgcccccaaatttgctttgcatggagaaaactctaacaagtcctcttgaacacagttttctgataacccagatcaatgaactacccaggcttcaccactatgcgatataggcatgtgagaaactcgtacttataccccctcaatacattaaaactaaatatatatatatatatatttttaaatcaatgggccaggtgcagtggctcacgcctgtaatctcagcactttgggaggccaaggcgggtggatcacttgcggtcaggagttccagatcagcctggccagcccgcctctactaaaaatacaaaaattagccaggcgtggtggtgcatgtctcccaccacggctgggaggtgtgcccaacagctcattgagaacgggccatgatgacagtggcggttttgtggaatagaaaggggggaaaggtggggaaaagattgagaaatcggatggttgccgtgtctgtgtagaaggaagtagacatgggagacttttcattttgttctgtagtaagaaaaattcttctgccttgggatcctgttgatctgtgaccttaccctccctccactattgtcctatgaccctgccaaatccacctctgcgagaaacacccaagaatgatcaataaaaaaaaaaaagagttctggagatcagtaaaaaaaaaaaagaaacagggtttctccatgttggtcaggctggtctggaactcctgacttcaggtgatctgcccactttggcctcccaaagtgctgggattacaggcatgagccactgtgcctggccccaaatgtgttttacattttcttcctatttgattcatctttgtcctgcaacataaatatgctacttttctaccgataaaaagacaaaatggaatttaaatctggcctggacttctcaaaaaagtcagtgtgatgaaaacatgttctagataaaacagaaatgagactgggcatggtggctcatgcctggaatcccagcgccttcggaggccaaggcaggagaatcacttgaggccaggagtttgtgaacagcctgggcaacatagtgagaccccagatctactaaaaatttaaaaattagctgggcatggtggtgcatgcccatatgtctggaggctgaggcaggaggatcgcttgagcccaggatttggaggctgcagtgagctatgattgtgccactgcactccagtgtgggtgacagagtgagaccctgtctctaaaaaaaaaaaagagagacaagatgatcaggatgagcgcagtggctcacgcctataatcccagcactttgggaggccaaaccaggtggatcatatgaggtcaggagttcgagaccagcctggcctagatggtgaaaccccgtttctactaaaaatacaaaaatcagctgggtgtggtggcgcacacctgtgatcccagctactcgggaggctgaggcgggacaattgcttgaacctgggaggcagaagttgctgtgagcaagattacaccactgtgctccagcctgggcaacaggaatgagactctgtctcaaaaaaaaaaaaaggggggatgatcaaacacaatgcatcaacctcccggagccatataaaccctaaccctaacccaggaagcaggcaagcctgtgtgtgagtttccactctattgctggtaccactcggctctggcaacccggaaggccaccttcccctgttgttactgtgtaaggaggaaggagcactggtttgcaagtcagaagcctgggttgaagcctctgctcgggttcctgctggctgtgggaatgtggggttacctttcctggctggcctcgtttccttcatgtccaatgcaggggttccagtcacatgcattgggcaccattacatgtccaagctgtgccaggatctagaaaaatggctggactcaggccaaggggccttcctgtctggcagtgaaaataagaggagataccaagggccctgagtctggaggggaagtcatgagcacagggcagtgccagggcccgggagctgccacagaggagcccaccttggtgacagacacctgtaggcacatccgtgatgcccagtgcccaacacagggaactggacaaacgtttcatgcacgactcttttttcccttcttggctaccttgaggaccttgattataatagttatcctttttttctttttctttttttgagactcttgctctgtcgtccaggttggaatgcagtggcaaaatcttggctcactgcaatcttcacctctcaggttcaagtgactctccttcctcagcctccctagtagctgggattaccggtgtgcaccactaggctcagctaatttttgtatttttactacagatggggtttcaccatgttggccaggctgatcttgaactgctgacctcaggtgatctgcccacctgggcctcccaaagtcttgggattacaggtgtgagccactgagcccagccggattataatagccttttcatgcaccaggggctttatactcattatctcatttcattcatatgagttgaagtcagcttaccccccatttcacagatgaggaaaccaaggcccagagaggttaggaattcgtccaaggtcacacagctaggaagtaggattcaaacccagacagccaggctgtaacacctaggctcttctcaggctcatgcccttcccaggggtctgggaagccctgacctgcagcctgtcaccttcgtttaccccccagcctccaggatattatgtgtgcaccggcgtgggatcctggaactggcaggaattgtgggttgtgttagtccctagactcccatcgcctatatgaaatatggttccttttgtggcttgggaggccatggccagccctgcgatgccattgactggtgagtgcatgcctgggaccaggctacaaaatccctcacactctggggtagtcaaggcttatgaggaagtacccaaaactgaagctggggtttggtccagggagatcccagtgtgcagtactactttgcaggcaggcagaggcctcttggataacatggccagtgaagccagatcttggtaccagctgccccttaccctggccatgggctgaaaacgttgccttaaaaaattggccaggagcggtggctaactcctgtaatcccagcactttgggaggccgaggtgggcagatcacttgaggtcaggagttcaagaccagcctggccaatatggtgaaaccccatctctactaaaaatgcaaaaattagctgtgtgtggtggcaggcgtctgtaatctcagctactggggagactgaggcaggagaattgcttgaacccgggaggtggagtttgcagtgagttgagattgcaccgctgtattccaacctggacaacagtgccaaaccctgtctcaaaagaaaaaaataataataatataaagtggccaggtgtgttgactcatgcctgtaatcccaccactttgggtcgaggcaggaggatcactggagcccaggagtttgaaacgagcctaggcaacagagtgagaccctgtctctatattaaacacacacacacacacacacacacacacacacacacacacacacacacacacacacacacacacaaaggcagccagactatgcactaggaactgccctgggaatctctttgtgttctcacaacaatcccatttcacagatgaagaaacctaggcacagaaatattcagtaacgtgtccaggtgcggtggctcacgcctgtaatcccagtactttgggaggctgaggcaggcagatcatgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgaaccgagatcacaccactgcactccagcctgggtgacagagcaaaactccgtctgaaaaaaaaaaaaaaaaaaaaagaaatattaagtaacttgtctgaggccacttagttaccaagacgtgggagctgggacttgaacccaggcagtctggctggattcatgcctgcagcctctgcactcctgctacttactgtgtgagaagcgcctgttctgtggaaggttgtgggctgagatctttccatgagttccactcatttacccccaaggctgttcttaaagacgggcatgacagttatgcccattttacagatggggccctgaggctcacaggggcatgccactcacccatttccacaaagctatagttagttagcagagggcagaattcggccgcctctcccctagcttgaaggctgtgattgacacagaggtttttttgttgttgctgttgtttgttcctttttcttttttttgagacagggtcttgctctgtcatcccagctggagtgcagtggtgcgatgtcagctcactgcaaactctgcctccaagatgcaaatgattctcgtgcctcagcctcccaagtagctggaattacaggtgtgcactaccacgcccagctgttttttgtagagatggggttagtagagatttgttttatagagacggggtttcaccatggtctctactaaaccctgtctctactaaaaatacaaaaattacccaggcgtggtggcacatgcctgtagtcccagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacgtcagcctcccaagtagctaggactataggcatgtgccatcatggcgagttaattttttgtgtgtttttattgtcttgagacagagtcttgctctgttgctcaggctggactgcagtggcatgatcttggctcaccgcaacctccacctcctgggttcaagcaattctcctacctcagcctcccgagtagctgggattacatgtgtgtgccaccatgcctggctaattttgtatttttagtagagacagggtttcgccatgttggtcaggctgctctcgaactcctgacctcgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctccgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggaggactgcttgagcctgggagttcaagaccagcctaggcaacatagaccccatatccacaaaaaatttaaaaaaggagtttgtgttcctgtagtagcatacttgggaagttgaggtggcagtatcacttgagcccgggagttcaaggctaaagtgagctgattgagccattgcaccccagcctgagcgacagagagatatgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgactgcagactgcaggacttttttaaagaccctgtctcttaaaaaaaaaaaaatcttagataagaggatgctgtgcctccctgggggtcttcagtcacccatggtcctggcaagagaggagggccaggagagagcttcacccacctgctgtcctgcccgtgtgacatccgcaggtgctgccatggccacgactgttgttacactcgagctgaggaggccggctgcagccccaagacagagcgctactcctggcagtgcgtcaatcagagcgtcctgtgcgatgagtccccagcagcaccatgccacccaccccgagtatcccctgggcaccctggcatagccagatgacttccgtgcccctgttgcaataaccactgcttccaagtctctgtagaccaccccttgggtatatctaatgtaagtgatatttattttatttatattttttgagtcagagtctcactctgtcacccaggctagagtgtgctgacgtgatcttggctcactacaacctctgcctcctgggttcaagcgattctcatgcctcagcctcccaagtggctaggactacagacatgcaccatcacgcccagctaatttttgtatttttttcagtagaggtggggtttcaccaagttggccgggctggtctcaaactccccacctcaagtgctctgcccgcctcggcctcccaaagtgctgggattacaggcatgagccatggtgtctggccctaatgtgagtgatctttaacactgagcacttgaaaaagaaaaccctgaagaaacctaattattcgatgtctggacgacaaggaagaagatagaaatggcatcagataataaacagtgtaaatgtttgtttatcagaaaggggctggtggtcgggacaagtaggaggatcgcttgagtccaggagtgcatctctacaaaaaagttaaaggattttttaacattggccaggcgtggtggcacacatctgtgatcccagctacttgggaggctgaggcaggaggattgcttgaagcccaggaggttgaggctgcagtgagctgtgatcgagccactgcactccagcctgggtgacacagcaaaatccagtctcaaaaaaaataataataatattttacataaccaaccacttctaaagattaaaaaaaaacccctatgattaaaaacctcaggtccctcaggcaatcataccagatatcgaaacaaagcaataacataaggactgcagtatttattttatttttatattatttatttattctttgttagtttttggagtgtgggttttgttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcagaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatcggctgatggtggaagcggaatccgcagacgctcagcaggtatcttgatattatcatctgctgagagtggagctgagggtggaaggggagtgagctgacgctcggaaggtgtcttgagattatcatccgctgagggtggaaggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtggagctgagggtggaaggggagtgagcagacactcgggaggtgtcttgagattatcatccgctgagggtggaaggggagtgagcagacactcgggaggtgtcttgagattatcatccgctgagggtggaaggggagtgagcagacactcaggaggtgtcttgagattatcatccgctgagggtggaaggggagtgagcacacactcgggaggtgtcttgagattatcatccgctgagggtggaaggggagtgagcacacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcataatatcacccttccactgagtactgccgacagctggagggtaaaggaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccactgtccacacatgttgcagcttctttttggagaatgttttccaggccttttatgttctgtctctgactctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatctcacctcaagaagtcacttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcacgtgtaatcataggactcggcagcttttgaaggtacagaggccacacaagaaccagcttagctgagcatcatttaaggccttcatttggaattgtccctgtgggtaataagttacattcactcttcactagtttacagtcagggcccatctgctattacaaatacggaacctctgacacttagaatattagatcaggggccccactgggtggggatgaaggtgtttttgcacaacacggttaccaacagggatgggactgtgatgcttgtaggcagcctttctctctgccatctccctctgcagggcttgagcacagagctgtagggagaaaaatgtatccatgtcctgacctggcagactatgtccaaaagcaaggaaaacaagcaaacttacccagttgcaaagagcctttcttgcagaaggggggatctgaaaaagccaacacatgagaaattgaatgttgagagagtctaagggccgtggcatcatctgcatcagcactgaactatcctgcaactgcagggaggaagctccttactttgcatttgtggtagtcctctgcccgccgccgcaactcttgcgcacgttgaaacattttcctatggattacaatcactttcatcagataaagcaccactttcaggatgattttaaataatctgccatgtttctgttatcctcacaactgtacccttacacaatctatctctacctagaaaacgtatttcagatggctataagagtacagtctgagccggtcacggtggctgacgcctgtaatcccagcactctgggagggcggggcagatggatcacgaggtcaggagattgagaccattgtggctaatatggtgaaaccccttctctactaaaaatacaaaaaattagccaggcgtggtggcaggcacctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaaaactgtacagtctgatccaaactgttgctgtattgattcctcctcttgcttactgcctgctgacttctgagatgatagtttccttccccattctcagtacatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaatactgtacaaaggttaaaaacaacactccaatgggcgtttcccaggagggtggggttcagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcagttcacagagattgagggcagaaaaaggaaacggcctaaaaagggtaagtttgctgtgttgccctcactccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccgtactgaagtccactggctctggttgagacccagaagagtcatgcatcagaataaaggtggacaggaaataccctggcctttgtagggactgagcctgcaccgacgacttcaattgcagcctgtatggaggacccctgaccatcccccagaagtagactcccatctcttctgcagcaagataacatgctactaggcctcaattcattgctaaacattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggccgggcacggtggctcacgcctgtaatcccagcacattgggaggccgaggtgtgcggatcatgtcaggagttctagaccagcttggccaatatggtgaaaccccgcctctactaaaaatacaaaaattatccgggcatggtggcatatgcctgtagtcccagctactcaagaggctgagggataagaatcgcttgaacctgggaggtggaggttgcagtgagccaagatcatgccactgcactctagcctgggtgacagagtgagactctgtctcaaaaaaaaaaaaaaaaaaaaaaattggtcaaatgtggtggcacacacctgtaatccaagctactcgggaagctgaggcagaattgcttcaaactgggaggcagaggttgcagtgagccaagattgcaccatagcactccagcctgggcgacagagcgagactctatctcaaaattaaaaaaaaaaaaaaaaaaaaaaaaggctggctgtggtggctcacgcctctaataccagcactttgggaggctgaggcaggtggattacctgaggtcagaagttcgagaccagcctggacaacatggtgaaaccccatctctagtaaaaatacaaaaattagctgggcgtggtggtgggcacctgtaatcccagctacttgggaggctgacgcaggagaattgcttgaacccaaaaggcagtgagctgagattgtgccattgcactacagcctgggcaacaacagcaaagctccatctcaggaaaaaaaaaaaaaaaaaaaagagaaaggaaaaccaatgccagtactagcaactcctcttcctccgaaaaaatgaaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttttctggcggtcttcctctttccattgattttgtcatgatggttgattttcgttgtcaccttcctcttacggattttagctctaacttttgtttccacatgtctccgtagagtaatgacgtctttcaggccaattttatttcctcgaaaggaagaaactcttttctttgtgtgcatacaaatggacctcagcccttggtgagagtgaggagaggagaaggtgagaaacctgagggcaagaagctgttctttccctttccagggcaaactcatttccacactatgcggattccaacagagccataccttcctgtctacggcggttggacctccaggctctctgctgtacatccgtggatccatcatgtccatttcgagaccagaagatagtcttcaggagagacacctaggaaataataatataagaatgacggctgggcacggtggctcatgcgtataatcccagtacttcgggaggccgaggcaggtggatcacggggtcaggagttcaagaccagcctggccaagatggtgaaaccccgtctctactaaaaatacaaaaattagccgggcatggcagcgggcgcctgtaatccaagctactcgggaggctgaggcagagaaccgtttgaagctgggaggcggaggttgcactgagccgagatcacaccactgcactccagcctgagcgacagaatgagactctgtcacatacacacacacacacacaagaatgacatgaggctggcacggtggctcactcctgtaatcccagcactttgggaggccgaggcaggcggatcacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaagcttgtggtgagctgagattgtgccattgcactccaacctgggcaacaaaattgaaactcttgtctcaaaaaaaaaaaaaaaaaaaaaggccagatgcggtagctcacgcctgtaatcccagcactttgggaggccgaggcgggtgaatcacaaggtcaagagatggagaccatcctgggcaacatggtgaaaccccgtctctactaaaaatacaaaaattagctgagcatggtgatgcacgcctgtagtcccagctactcgggaggctgaggcaggagaactgcttgaacccaggaggcagaggttgcagtgagccaagatcccaccactgcactccagcctggtgacagagtgagactccgtctcaaaaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcatcccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagatattaaatatttcttctcatcatagctaaaatgcaatgcaaatcccatctcagatgtgggtcagatacctatgaatctcctgaggtggtcattgaaatgactttttcttgagacagagtgtcactctcaaccatgctgaagtgcagtggcgctaccttggctcacggcaacctccacctcccagattcaagcgattcttgtgcctcagcctcccaagtagctgggattacaggtgcctgctaccatgcctggctaatttttgtctttttagtagagatggggtttcaccatgttggcccatctggtcttgaactcctgacctcaaatgatccatctgcttcagcctcccaaagtgctgggattacaggcatgagccaccacacctggcctgaaataatatctttcaaattctttgtagaatttgttttttcctgatttctgcacataggataaaaaaaaaatcatgtactaggatttcgagagaagcaatgggtaatctaaaaagatgaaaagagcaaccacgtcaatcccacagctactgctagatttcataggaaaggtagctggcccagtttggagctaggggaaatgtcaaacacatgaagaaatgagaagccaagaaatgccatcacgcatgaatgcttcatggcacccatgatgtccctgcttaggaggtaatggtatagatgactagatgacaaggacaaagatgagaggtgcgaagttgtccaagtccaacagctcaactgaactttcctaagtggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacaaaaattagctgggcatggtggtgggcacctgtaatcccagctacttgagaggctgaggcaggggaatcacttgaagccaggaggtggaggttgcagtgagccgaggtcacaccattatactccagcctgggcaacagaaggagactcgtcttcggggtgagaaaagaaaaaaaaaaaagaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggtggtaaaactgaaacatacttcctcttcccttgaatataaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggcacaacttagcagccaaattcttaccaagtacagacttttgacatactgatctctctccagttccaagtcggaacatgcactttgaatgatgtcattcaaaattaccctgcccagacacacttttcattgattctcttggagggcagttctaagagtctctggggctttctctgcatcatgagacgcagtgcagttctgcccttcaccttccggcagtttgtcacctcgtccctatgacctcacaggaactttgtctcaggccaattgtttgttccttggcctctttcatttcccctaaaaatcatttgctgcccctctaaatggcctacatctccatctatctccctctcccctcagaagagggtgctctttaagcatcagccatccggcccttctagcagtctcatttttcagctggttcccatgtttatgcctgttctatgtttttcttttcctgttaagctgtctgttgtcagctcatttctgcagtgaatcttcagagaagagattggaagctttccttccacccatacgatagaactacaaagcagaagagtttagaaagaatttcctatttaagtgacgaaacctcatactccatttgtgataaatagcacaaaggttaaaaaaacttatttttgaccaaaagctctgttgacattctattaaacaaacaccgacctatttaattttcataatgcaaatggcagatgttttcataattcttatactaataaatcatttccctgattttttgggtaaaaccacatattcataatgaagtccagaaatgtgaattgttttatataatttattcttatttgtgattacaagtatacctctacagaaagttagtatactcacccaaaggtaaactatccagagggtaatgacaactttataacttgtcggaaacgcaataatgacatgtaaccaaggacttccaccaaagtcagtcccacgatgatgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagaagtcacatgtttttcagatggctggtagtgttttcaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaacctcttttttttttttgagacagagttccgctccactcagtcgcccaggctggagtgcagtggtgcaatctcggctcactgcaacctccagctcctgggctcaagccattctcctgcctcagcctcccgagtagctgagattacaggtctctgccaccatgcccgactcatttttgtatttttagtagagatgaggtttcaccatgttggccagtctggccttgaactcctgacaggcgatctgcctgcctcggcctcccaaagtgctgggattacaggtgtgagccaccgtgcccagccatttttttgtttttgtttttgtttgttatttttgagatggggtctcactctgtcacccaggctggagtgcagtggtgtgctcccggctcactgcaacctctgcctctcaggttcaagtgattctcctgcctcagcctcctgagtagctgggagtacaggtgcctgacagtgcactcagcaaatttttgtagtttttgtggagatggggttttgccatgttggtcagggtggtctcgaactcctgacctcaggtaatctgcccgcctcagcctcccaaagtgctgggattacacgcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttcttttctttttgttttgagacaaagttttgctctgtcacccaggctagattgcagtggcatgatctcaactcactgcaacctccgcctcccgggttcaagcgattctcctgcctcagctactgagtaactgggattacaggcgcctgccaccacgctcggctaatttttgtatttttagtagaaacagggtttcaccatcttggccaggctggtctccaactcctgacctcatgatccacctgccttggcctcccaaagtgctgggaatacaggtgtgagccactgcacctggccagtagttatcttttctttaaagttatttacttgttttttaaattgatgtataacattggatgcatttattatatatcacatggtaaaagaatccctctaaataatacttctctcttggattatatgaatctttgtcatttaaatctcagcataagtaaaaaaaaaaaaaaaatacaatgaagagattacttcattcacaaataagtatcaaattttagtgcttaaaaattaacaaggtgggctgggcgtggtggctcacgcctgcaatcccagcactttgggaagccgaggtgggtggaccacgagatcaggagattgagaccatcctagctaacacggtgaaacccgtctctactaaaaatacaaaaaattagcagggcatggtggcacgtgcctatagttccagctacttgggaggctgaggcagaagaatcacttgaacccgggaggcagaggttgcagtgagccgagatcgcaccactgcacttcagcctgggtgacagagcgagactctgtctcaaaaaaaaaaaaaaaaaaattaccaaggtggagatcatgaaaatggcatgaatagtgtgggatttctctaagattgttgatattaattccattagactcttatgtgagtgaagacgaagacttcccctgagtaagttcagacagcttctgataacatttctacgtcgattcctcaggatttaactatatattcttgaaaacatctcaattttaaatgtttctttcaagatggtgaattaaacagagatagcccttcaacaggttgaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggctgggcacggtggttcacgcctgtaatcccaacgctttgggaggccgaggcgggcggatcacctgaggtcgggagttcaaaaccagcctgaccaacatggagaaaccctatctctactaaaaatacaaaattagctgggagtggtgccacatgtctgtaatcccagccactcgggaggctgaggcaggagaatcgctcgaacctgggaagcagaggttgcggtgagctgatattgccccattgcactccagcctgggcaacaagggagaaactgtctcaaaataaataaataaataaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcagatcacgaggtcaagagatggagactatcctggcgaacatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgaggtcccgccactgcactccagcctgggcgacagagcgagactccgtctcaaaaaaaaaaaaaaaaaaaaaaaaaaaaaaaaaaaaaaattagccaggcgtggtggtctactaaaaatacaaaaattagccaggcgttgtaatctgagctactcaggaggctgaggcaggacaattgcttgaaccccagaagcggaggttgcagtgagccgagatcttgccactgcactccagcctgggcgacagagtgagactctgtctaaaaaaaaaaaaaaaaaaaaaaaaagtcatcaaaccagatgacacaaatcaaatgacatttcactttgttttggtccattttctttgttaaaaacaagagtgcagcggggccatctcggctcactgcaacgtccagctcctgggcccaagcgatcctcccacctcagcctctccagtaactgggataacaggtacgcaccaccaggcccgactaatctttattggaattttttgtagagatggggtttcgctatgatgccctggctagtcttcaactcctggactcaagtgatctgcccacctcggccctctaaagtgctgggattacaggcctgagctgtgtaatttcatgccacgtgatacagcccagtaaaaaggaagaaaccccacgggtccagcgtctactcacagagatgcactgatggctgataaattccagtaggagcccaaagaggagccaaaagagcatccaccgcacccgcatgtcctggtcctttcagggcgccctgaggcggccaggacagaggtggaggtggcttagggcaggggggagggaaggggacgggaccggggccggatctgagttggggagggggaggggagggggaggggaaggggaggggaaggggggaagtaagggaagggaaaggaggagaagggggctgttgggcacctggaggaggtggaggaggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaatcagagggagacaaaaaggttctgctatccaccaaaccttcttcggtctgggccctcccttaccaaccctggggctttatactccctctccaccaatccctgatgaccccggtggtgcctcacaatggacagtgcctcacaatggacaatgccaagtagcgcccgcatcattccaatgacccctcccccatctcagtctcccacactcctcccaaagacaggtcctctctggaaccttcacaaacctgatttctggtcctccccaaccagctccctgtccctgcttctgggcgctccttccttcctgagctcccagggttcctcaaggtcacttatggcgacaaaacataaaaaacaaatgatggcaggatggcaggaagaacctcatacccaagcagagtgccaggttttacagcctccgctcagccattcatatcctaagcaacaaaacatcagcagggtgcggaaggtcccgatagtaaaccatctccatcacatccatgtagccatccgtccatcaacctgtatctcaggaacaaatgtagatacattcattttaagcatgcctggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcaccgctaacccacctagacattttaacatccgaaaccgagtgatgacgtccttatctatatcatcttactgcctgtgtgtgtggactttaaattctgaacccaaatgagggggagaaaaccaagttgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcaactttcctggccctgtcctctgctaaacttcccacaggccttctgcccgatcacacagagtatgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaaacgggctgggtgtggtggctcacgcctgtaatcccagcactttgggaggccgaggtgggcggatcacaaggtcaggagttccagaccagcctggccaatatggtgaaaccctgtctctaataaaatacaaaaattagccgggtgtggtggtgggcgcctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttcctgccctagatttggctgggcatggtggctcacgcctgtaatcccagcactttgggaggctgaggcaggcggatcacgaggttaggagttggagaccagcctgaccaacatggtgaaaccccatctctactaaaaatacaaaaattagccaggcatggtggcacacgcctgtaatcccagctactcaggaggctgaggcaggacaatcccttggacccgggaggcggaggttgcagtgagccgagattgtaccattgcactccagcctgggtgacagaatggaatgagactctgtctcaaaaaaaaaaaaaaaaaaaaagcagccctagatttcggttgtggtggttgtaaaaggagagaccaagtaagtgggggttgaagtcagattagagcaaaagtgaatggcagagagtactataatgtccatgaagggctgctagagtcaccgtgatcatagcccaagcagagatagggaaaggaagatgtgagcagagtttggggtctcgaacaatggaggttattcgtgcagcccaggaaaggctccccaaagccaggatcaacctcccttggaggcggtccctcatggaggcatggtcaggcaccttagatttgagaacagctatgttgctgctgaccagctgtgtgaccctgggctggtttccttccacacaatgggagtgccaatggctgcatgcatgcaaagaccgtctgaggataggaggaagcaatctgttgagcacccgtgtacctgagtgtcatcacctcccaagggcatccttcgttccagagctggcgccttggaaggcccttggtcactgaaggcagtgatgatggtaacagcagtaaatcatcatttacggctgatgagggaaggccaggggtagggctcctaggtcctggataagaatgagggtctgggcactcctggggacagctgagtggtaggactcctgggtccccagggggaaggtccatcttcagtggcattgggcctaggctgggatgctgagttatccactggagcatcagcagtacaggcaggcacagaggcagtggatccatcggaggtggcaggtgtaggatcgtctggtgagcaagtagagtcaccaaatctggctgaccactacccccactacccccactatccccacagacgatgccctgtcccttgcctcatgctccggcagggtacaggctcgcacctggggcctcaaggagcatctctctaagacctctgtgtcctggtcattgaatgggcacttgagtcacccagggccattggaacaaagaggaagaatcaggccccacgatgttttgggagagtgtttagcacaggaaaatgcgcagaatacatgcacgacacgggggcactgtcagtgtgggagcaatggtttacaacctccagccctaatctgagcactctcacctgtgcaatctgaaaggaacaggagacttgcaggaaagacagtgcctggatttaacttaaaggaactaaaaatgttggaatttttactcttgatatccttccaaatcaactctctcaatgttcccatcctcaaaactatcatatggggtaactgaggcagtcagagatttactgactcaatgtcactcaattgattctgagttcactgctgattacatccgaccaaactgctttttctgaagtctactccgtttaatcatgctggtgatgattttgtgcggctctgggacaaactccacctggctgaagataaagcaaatctgcggtgacttagtcctcctgtcatttcccatcagttccccactctcctcctctgcccctccacagtctcccatgcaggctgacaccatatgacggccttaatggagtccaccgagtatttcaggttctctcctgggccacttgaaagtggatgtacccatgggatttgctttgacccaggagatgtgagtggaagtgaagcgtgtcacctcgaggcaaaagagttgggagccattgagacgggccactctctccttcatctcttagagcagctgacagctcccatatggaggctgctcctttattctcgtggcaggatgagggcatgtggggcacagggcacaggagagccatggaggatgtgcagcatgggcaggaaaagagccttcagtggtgtacatttccatagtttggggctgtttcttacctacagtgatacctagcccatcctagcaggcatgcaccatctactccacactctgtgatgcagactagcctgccgtcagaacacgaactggtggtcagacacaggtaggtttcagttccagctctgcctcttattgactgcaacctcaggcttaactttcagtctctgagcctcagtttcaactctgtaaaatgaggtggctataccatctcaggttgcagagagaattaaatgaaatataagtgcatgtagagcattgaacccagggcctggcacacacagtgagtacacaatgttagccaggtagcttcataatgcatactgattgttaatattcagacaatgcagtaaagtgttaccaaaaataaaagtaaacttatttgcatatgtattctttcaatctttatttttaaacagggtaaaactatgcatattctttcatagccagtgtttttctcttcatagtatattgttaaaataattttacttggaccgggtgcagcggctcacacctaaagtcccagcactttgggaggccgcggtgggcagatcacgaggtcaggagttgacacgagcctggccaatatggtgaaaccccatctctactaagaatacaaaaattagctgggcatggtggcacacacctgtagtcccagctactcagaggctgaggcagaggaattgcttgaacccgggagacggaggttgcagtgagccaagattgtgccattgcactccagcctgggggacagagtgaaactctgtctcaaaaaatatatgtgtgtgtgtgtgtgtgtgtgtgtgtgtgtgtgtgtgtgtgtatctatataaatctcaaaaataaaagatcatttttgagattatcattttaaaagacaagataatgttcaacttaatgactaatttaattattactattggactttttgtagactaaacagagcattcaaaacaaatgaaggagaataaaaaatatgtattacatgttgtaaaataaatgtgatgtggttaactcttttattcaaagttatagaacatatatatgtactatagaatgtatttcttattatgagtcatgttaaaaagtagtttagaagctgttgatttgaatttccttttcaaattttgcaggataatttttttttttttttgacagagtctcgctctgtcgcacagtctggagtgcaatggcgtgatctcggcccactaaaacccccacctcctgaatctaagcaattctcctgtctcagcctcctgagtagctgggactacaggctcacaccaccatgcccggctaatttttgtatttttagtagggacgaggttttgccatattggtcaggctggtctcgaagtcctggcctcaggtgatccaccagcctcagcctcccaaaatgctgggattacaggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcgtaagcttcccccagcatcacccgctatgagatgtgtggcagctgagacccgggaactgctcaagggcaccaggccccatctgtctgcactcactcaccttcctcaggtactcgcatgggcatgtcactgactttacatgctgctgcagctccttggtgagctggccctggtcatgggacaggaactgtggggtcaggacaatagagagcttcaccatttgcagaatgagaacaggggctcatgatgagtgccaacctattagataattttaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttctgtcataattagtgggatccatttcactattattggatatacagttctgtgcctgaaacctacaaaaaaagaaaatgttaagtctaaaaagcattagtgatttctcatttttatattactaattataaccctatttaatcacacaaggccttgtccgtggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataatgagaatccttagctcattcggttgtggtgaggggtgaatgatttggcacacaggaggggcttgttaacattagctgtgatgatctccttccaaatcttcattttcagagccacagatgaggccacagtgcaaccaggtgaccttagagtgtaagtacacgatcgccagctatgctctatctccaccataggtccaagactgggtagttctggcctggaggtttctgctacatctgccttctcagtgttcacctaaggacttttgtattttcctcctcgcatccccacagatggggttcaggctgccggacacagctgggtgatgccagggcagtggtcacctgtgccagccccgtgaggtagctggaggatcattgttccttccttctcgggctctgggcagatgccagggctggggtgacccatgccctcaagtttcttgctttggtgggccacattttcccttggcaaagagggtaaaggtcacaggatgccagagagctgtgacttctctgtgccctgggcccaaactatgaagacctgacacactatgctaaaagtccaaggctgggtgctccccagagcttcttgcctcaccgcttctgctgagggaggaatgaatactatgtcctcccagagctttgggagcttgtagcaagcagcctccccagcgcaaaatctcttggaaacctctaactgtgtctgaaacattagtgcaaatgttgcatcctatttcccatatgtccgcatgttttagaaaaaaatcctcaatttcctaaatatgcaagaaaaatcggtattgtaggacaatgtgactttttaaaaaatgttatttaaaaatcttccccacctccttttctgccctccaagactgccaaatacttgttgaacatatattattaaatgcctactacatgccagccatgattcatggtcttggggacacagcagagaacgaactgacaggattcctctcttatgtaactcacattcttatatgataatgataagggttaacattaattaagctgtcactgcatgttagtcacggtgcagtcattcccacacattattacacttaaacctgccagcaagcttgcaaggtagttgtttttcctttaaaaactgagtctcggaatgatgaagcactctgtccaatgtcacacagctagtaagtgtggagaccttgcatccaatcaatgcccgtctcattctaaaggccatgttatgtgttctccagcccatggagaataattttaacacagtcaatgaaatttctacacaacaatgttcttgtctcaagtccaagaatgcctcctacacctcctataatactggctttctggtgagtaaagatgccattctcatgtgtaatcaggtggcaaatggagatatgaccaaagtaaccatctgcctacactcataaccctgtacacactcttcctgtgtcgattcaattcaagtaccccttttgatcacttagcaaatctgacctttaaaagggttagggtttttatatccatgtaagtttctgtattgctttggaagtctctggttaaattaatactcttttaatagtgacctgtgattctgttttgatcaagtgttttcaaacttgacgtctttgatgggtttctccagtgtcaaaatcctaaatcaagtctttttggcttaaaactaactttgggatttttttcagctgcatcccttggggagtctaaagaatgtatctctcatcttgtagaggtattaagtgattcgatttatttggtagattaaatgggcaggcattgtcaaatgtggcgatactgcatgggagggcactgtcaagtgaggtgacattagatctcatctcagttatatttatgggtatgttgttgatatgcgtgttccaaaaattgcatacatttatacaaatttaatatgatttgtaattttgatagttatgctaaatatttgctaaagttatatttgtataaacatgtcacgaatggctgggcaccgtcactcatgcctgtaatcccagcactttgggagacaaaggcacgtggatcacctgaggtcgggagttccagaccagcctaatagagtgaaaccctgtctccactaaaaatacaaaaattagccatgcctggtggcacatgcctgtaatctcagctactcgggaggctgagacaggagaactgcttgaacccaggatgcggaggttgtagtgagccgagatcatgccactgcactcccgcctgggtgacaaaggtagaatctatccaaaaaaaaaaaaaaaaaagttattatttctgaagattgtatgaaattcataaaagtctgctggccctgatatgatgctgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcctgtttttgagacacagtctggctctgtcgcctaagctggagtgcagtggtgggatctcggctcactgcaaactctgcctcccgggttcacgccattctcctgcctcagccacccaagtagctgggactacaagtgctgccaccacatccagctaattttttgtatttttagtagagacagggtttcactgtgttagccaggatggtctcaatctcctgatctcgtgatctccgcgcctcggcctcccaaagtgctgggattacaggtgtgagccaccgtgcccagcctaatttttgcatttttagtagagaggaggtttcaccatgttggccagggtggtctcaatctcctgaccttgtaatccgcctgcctcagcctcccaaagtgctgggattacaggcgtgagccactgcaactgactttttttttttttttttttttttttttgagacagagactcactctgtcacccaggctggagtgcagtggcatgattttggctcactgcaacctccacctcctgagttcaaacaattatcctgcctcatccttcggagtacctgggattacaggtgcgtgccaccgtgcccggctcatttttgtattcttagtagagacggcatttcaccatgttggccaggctggtctcaaactcctggcctcaactgatccactctcattggccttccaaggtgctgggattataggcgtgagccaccacaactggctcagtaaatacattttttattatcaaaaaagagtagtgtatggttggcgtattctgtgtagaatgtattttattgatgtctcctatttttataatttctgagttaagtactttttaattaatgctttttagttttgggcagattcagttgactaaagcacctcatttcccagatacatgaaataaaatatttggcttcttttccaatttcacactgatgttattttgtgaaaatcagtgctttaagataaatcgttatacgttaagataaacatgagaaacttgatctaatatttaatatttattcagttctacactttattaacttctacaccagcagatttagacattatgtaaccatctcaagaagtttcacttggatgtaatgcttcacgcttgtaatcccagcactttaggaggctgaggtgggaggactgcttaaggcaaggagtctgagaccagcctgggcaatacagcaagatcccatctctattttaaagaaaagtttcactttgggaggccaaggcgggtggatcacaaggtcaggagatcgagaccatcctggctaacatagtaaaaccccatctctactaaaaatataaaaaattagctgggcgtggcggtgggcgcctgtagtcccagctactcgggaggctgaggcagaagaatggcgtgaacccgggaggcagagcttgcagtgagctgagattgcgccactgcactccagcctgggcgacagagtgacactccatctcaaaaaaaaaaaaaaaaaaagtttcggcaaattccatctaagaattccaccagagttctgttgtctccaatgtcatcttccacagatttcaagttgtgaagccctgaactgttaatttatcttgagaatgtatatttaagcttaatttaagactatatacctaaaaattgagcatataatttctataatttgtttatgtaaatttctgtaagtcataagtatgtggtttccaagtgtataatttatctgaatgtaataggcattaatatattttacattactgggaccatagtacagaaatttctaaatggtttgtaaaataacttgttatttgtgttgttgtaaaagcagttaatacaatggaaaaactcgtaataagaagatacagtttaacatcaaaaagtttacccaaggtaattatgagtactacctggcaaaacttcacggaagctgtggtatcacttttatgatggaagaatggtgtttgcattttgtgtaaaagtacttgcggctgggcgtggtggctcatgtcccagtgctttgggaggcgaaggcaggtggatcatctgagcccaggagtttgagaccagcctaggcaacgtggcaagagcctgtctctccaaaacctacaaaatttagccaagcttggtggtgtgagcctgtagtcccagctacttgggagactcacgctggaggatctctcgagcccaggaggcagaagatgaataaataaatggaagcaactgaatgggatgaggtctctcttgaaggagagagcaaaagagatttaaatagtaacaattataataaggctgggcgcggtggctcacgcttgtaatcccagaactttgggaggccaaggcaggcggatcggttgaggtcaggagttcaagaccagcatggccaacacggtgaaaccctgtctctattaaaaatacaaaattagccggacatggtagtgcgtgcctgtggtctcggctactcaggtggctgagacaggagaatcgcttgaacctggtaggcacaggttgtagtgagccgataaatataaaaagtattagagtactaacagaggaaagtttccactgatcaccttttagctttaaataatgcagaagcatttgcccagtttacttgtaattaaaaatcatgcatcattcacaatttatatcttttttgtttgtacaaaaatgaacacaagttattctcttttatctgtattgtgattggtttggtgagagggaattaggccacttgagagtttgtgtgtgtttacaattttctggccaggcacggtggctcatgcctgtaatcccagcactttgggaggccaaggcgggcggatcacttgagctcaggagttcgagaccaaattgggcaacatggtgaaaccctatctctacgaaaaatacaaaaattagctgagtgccgtggcttgcgcctgtcctcccagctacttggggggctgaggcagtaggatcgctcaagcccaggaggtggaggttgcagtgagccaagatcacgtcactgcactccaggaagggcaacagagcaagactccttctaaaaaaaaaaaaaaaaaaagaaagaaagaaaagaaaattaactttggtatttcaggttgtatttaaatggagacttaacatgaactatgttcataacacttgaccaaattaagtgtagatcgtctctttaataaagagatcatctggaactgcaatttctaactcatacatcattgctacaaaccttatttgtttactatttctcttccaaggaccatcagtcatcctttaaaattcatttcaagctctgaaaagatattttttgttacatgggcaatttacttttagtacagtaaaatgttatgtgaatttctacagtatgtttgccaaaatgaattatatctagaatacgcttaacaatatattctggaggcagctttcatttgaaattaggttcaccttctgagagtatgaaaaagttaatgggtttttgtgcctgaagattttgatgttgcatttggctacatttaatccactttcacccataagttttaacatctaaaaaaattaaatcactgctaatgcaattaaaatgcattatgaaatgcatttctgtccaggctggagtgcagtggcacaatctcggctcactgcaagctccgcctccctggttcacaccattctcctgcctcagcctccctagtagctgggactacatgtgcccgccaccacgcccggctaattttttttttttttttttttaatgaggcggagtctcgctccgttgaccaggctggagtgcaatggcatgatcctggctcactgcaacctctgcttcctgggttcaagtgattcgcctgccttgctgggatgacagacgtgcaccacaatgtccggctaattttgtatttttagtagagacatggcttcaccatactggccaggctggtcttgaacttctgacctcaggtgatcccaccttggcctcccaaagtgctgggattacaggcatgagccactgtgcccagcttaagatctctgttttaatgttaatgctggtcagttgtgtctggattccagagggaggaaggtagaatgaggcatgttgacacctccccttcccatcatggcctaagctggtcttttcagtttactttggaatgtccttgctcaacaggaagggtccattcagtcggattgggtggcttagaattttatttttggtttacatctcaactatcacagcagccgggcgcggtggcttcacagctgtaatcccagcacattgggaggctgaggcaggggtatcacctgaggtctggagttctagaccagcctgaccaacatggagaaaccccccgtctctactaaaaatacaaaattacccgggcgtggtggtacatgcctgtaatcccagctactcgggaggctgaggcaggagaatcgcttgaacctgggaggcggaggttgtggtgagctgagatcgtgccactgcactccagcctgggcaacaagagcgaaactctgtctcaaataaataaataaataaataaataaacaaactatcacagcataaagtaggaatatttcgttactgtctagttaaactggttaatgcagaaaggaagtctggaaattccagttttaaagtaaaattttggacattgtaggattgattatttggcatagttgtgatgtttgttcctgcgttatggttttgttggcagggcagcctttaaggacctgtatattttcttctagactctatatattccctgtgagtattagttgtatggtcaaactggcaaattttaccataggtataaataatagagaatgtggaagaatagtgaatagtgtcagagatagttaaaagtccatacaatagtagagaaggtaataagtaatagtggcttggactaaatatttgttgaataaatgttttaaaaaacaggctacctacaatttgtgttgaagatatgaatgaatgaagtttccacacctttatgtggagacctgataagtaagcaacaataaggaagggtccccaggttggggagagccccaagttgagaacaataatgaacaatgattgtatgaacaattgttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctaggttgttgctacccgatatggtttggctgcgtccccacccaaatttcatcttgaattgtagttcccataatccccatgtgtcgtgggagggacccggtaggaggtaatcgaatcatgggggcaggtttttcccatactgttctcgtgatagtgaatacatctcactaaatctgatggttttataaagggcagtttccctgcacgtgctctcttgcctgctgccatggaagacatacctttttgctccttgccttccaccatgattctgaggcctctccagccttgtggaactgtgagtacattaaacctctttttctttataaattacccagtttccagtatttcttcatagcagtatgaaaagtaactaatacactacccgagacatcttaggagatttgtaatagctgtaatgccaggtccaccatatttttagcataaagcaaatgtttacgcgtgatatgactgcacgggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccatctctacaaaaaatacaaaaattagctgagcgtggtggcacacacctgtagtcccagcaccttgggagggtgaggcaggaggatctcttgaacccgggaggtggaagccgcagtgggcaatgatcatgtcagaggtgtgtgaaccagagcaactccatcttaaataggagccaggaaaaatgaggctgaaactactgggctgcattccctgatggttaaggcattctaagtcacaggatgacatagaaggtcagcacaaaataccagtcataaagaccttgctgataaaacaggttgcagtgaaggagctggccaaaacccaccaaaaccaaaatagagacaagactgacctcccatcatcctccctgctacactcctaccagcaccatgacagtttacaaatgccacggcaacatcaagaagttaccctatatggtctaaaaagaggaggcatgaaaaatccactccttgtttagcatatcatcaagaaataaccataaaaatgggcaaccagcagccctcacggctgctccgtctatggggtagccattcttttattcctttactttctctctttttttttgagatggagtctccctctgtcacccaggctggagtgcagtggcgcgatctcggcttactgcaagcttcgcctcccgggttcatcccattctcctgcctcagcctccagagtaggtgggactacaggcaccggccaccacacttggctaatttttttgtatttttagtagagatgaggtttcaccgtgttaaccaggatggtcttgatctcctgacctcgtgatccacctgtctcggcctcccaaagtgctgcgattacaggagtgagccacggtgcccctcctcctttactttcttaataaacttgctttcacttcacactgtggcatcaccctgaattctttcttgcacaagatccaagaaccctctcttggggtctagattgggacccctttcctgtaactatcatgctactgcactccagcctgggcaacagagcaaggccctgtctcaaaaaaaaaaaaaaaaaaggaacatgacttaatacattcattttggaggataagtctctcaaaataggcctttcactgggggaaaatggtaaaaatactccctggtaattcaagaattggagactcctgagatgctgctcatattagctgagcacttatcaatacttcacttttttccatatatactcaaggaacaagtgctatttaaagtgtttcactccactgggctaggtgcaagactataaagaggtgtgaggatcaacacttttatgaaaaccagtgtcattctggatatagtttcagatgctagtgcaaaggaagctcttggtatacggaaaaagtattcaacaataaattaggcatggttgcttccattttctgcctcacatactttttttttcgtggttaaagtgatataatgtctatgatattttagattggcagttgcaaactagtggtcctcagcgtgctttttatgacacctacaaggtctgaagactttgatttcatattaaaaatctgggtttcaggctgggtgtggtgttgcatgcctgtaatcccagcactttgggaggctgaggcaggagaatcgcttgaaccagggaggtggaggttgcagtgagccaagatcgcgccactgcactcaagcttaggcaatagagcaagactccatctcaaaaaatgaataaataaataaataaaatctgggtttcaggccaggtgtggtggtgcactcctgcaatcccagcactttgggaggctgagatgggcagacagcttgacctcaggaattccagactagcctgggcaacatggcgaaaccccatgtctacaaataatacaaaaaaattagctgggtgtagtggagtgtgcctgtaatcccagcaacgtgggaggctgaagtgagaggattgcttgagcctgggaggttgatgttacagtgagctgagatcgccctcctacactccaacctgggcaacagagccagaccttgtcttaaaaaaaaaaaaaaaaaaaaaaattctgggtttctggcatctcaaaaaaaaaaaaaaaaaaaaaaaaaggaaaggtcagggcacatggctgctacagtcctctattaagcaatgtgccacagcagggtccctgacccctgggccatggacatgtactggtctgtggcctgttaggaactgggccacagagcaggaggtgaatggtgggtaacaattgaagcttcgtctgtatttctggctgctccccattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagctccctatagactttgcttcctaccgtcttacgttctgccttataggcatttgactttgcaacccttgtttttgttagtatgctacgctggtgacattgaccaaattgaccacacattaattataagcttagttggtgatgacctcaacggaataacgtgacataagtattgtgacaatacttcttgcatgtatctgcaggtggaattgtaaacctggtggtccgagatggtctaattccatcttcctatgtatctccttatattaatagtggtaacatttgtggtggtgattcagcatttcaatgcctcttctcatggcaacaacaaacgttttccttctgaatcaacattaacctagatgttactgcggatcaaaattagactctacattttcaaccacagaaataccgagcagtaaaaatttttcttaatattgattgcctacataggttgtgtaattagcatatgtttacagttctatgatttctgcgtggctgctacagagctggagggggtaaagcaacagtattttctcagttgtccgagcagcattacattataataaataggtaatattaaactgggctgatgagagttgcaaaagactactttaatgttcatatggaaccaaaaaagagcccacattgccaagacaatcctaagcccaatgaacaaagctggaggcatcatgctacctgacttcaaactatactacaaggctacagtaaccaaaacagcctggtactgctaccgaaacagacatatagaccaatggaacagaacagagccctcagaaataataccacacatctacaaccatctgatctttgacaaacctgacaaaaacaagaaatgcagaaaggattccctacttaataaatagtgctgggaaaactggctagccctatgtagaaagctgaaactggatcccttccttacaccttatacaaaaattaattcaagatggattaaagacttaaatgttagacctaaagccataaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaaaacaaaccccatcaaaaagtgggcaaagcatatgaacagacacttctcaaaagaagacatttatgcagccaacagacacatgaaaaaatgctcatcatcactggccatcagagaaatgcaaatcaaaaccgcaatgagatatcatctcacaccagttagaatggcgatcattaaaaagtcaggaaacaacaggtgctggagaggatgtggagaaataggaacacttttacactgttggtaggactgtaaactggttcaaccattgtggaagacagtgtggcgattcctcagggatctagaactagaaataccatttgacccagccatcccattactggatacatacccaaaggattataaatcatgctgctataaagacacatgcacacatatgtttatcgcggcaatattcacgatagtgaagacttggaaccaacacaaatgtccatcaatgatagactggattaagaaaatgtggcacagatacaccatggagtactatgcagccataaaaaaggatgagttcatgtcctttgtagagacatggatgaagctggaaacgatcactctcagcaaactatcacaaggacaaaaaaccaaacaccgcatgttctcactcacagatgcgaattgaacaatgagaacacttggacacaggaaggggaacatcacacactggggcctcttgtgtggtgggggagggggaagggatagcagtaggagatacacctaatgtaaatgacgagttaatgggtgcagtacaccaacatggcacatgtatacatatgtaacaaacctgcacattgtgtacatgtaccctataacttaaagtataattttaaaaaataagtaaataaataaataaaaaaagaaacaattgctggctttgcaattctctttcctccaaaatcgccaaggcctcaatttactcattgctgaaaaaggacgactctgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccaattcttagtcctttaatacctgtttttctccttctcttattcggactgtgtgtcttctgtttagtttctcaattcatacaaaaccgtattcaggccatcaccaataattctatatgacaaatgctccttctaacaaccccacagtatcagcccttaccccaaaatctttcttcagttgaatctctcccactgtaggttcccaggccgcccctaatcccgctcgaagcagccctgagaaacatcgcccattatctctccatatcacccccacaaattttcgccaccccaacactttaccactattttgttttatttttcttattaacataagaagacaggaatgtcaggcctctgagtccaagctaagccatcatatcccagtgacctgcacgtatacatccagatggcctgaagcaactgaagatccacagaagtgaaaacagccttaactgaagacattccaccattgtcatttgtttctgccccaccctaactgatcaatgtactttgtaatctgccccactcttaagaaggttctttatcatctcccccacccttaagaagtttctttgtaattctcctcacccttgacaatgtactttatgagatccacctcctgcccccaaaacactgctcttaactccaccgcctatccccaaacctataagaaccagtgataatcacaccaccctttgctgactccttttttggactcagcccgcctgcacccaggtgaaataaacagccatgttgctcacacaaagcatgtttggtggtctcttcacacagacacgtgagacaggagttcgagaccagcctggccaatctggtgaaactctatgtctctactaaaaatacaaaaattagctgggcatggtggcgggcacctgtaatcccagctactcgggaagctgaggcacaaaaattgcttgaacccaggaggcagagtttgcagtgagccaagatcacactgtcaggcctctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactgttcaatgtactttgtaatctcccccacccttaagaaggtactttgtaatctccccaacccttaagaaggttctttgtaattctccccacccttgagaatgtactttgtgagatccacccctgcctgcaaacatggctcttcaccccctatcccaaaacctgtaagaactaatgataatccaccaccctttgctgactctcttttcggactcagcccgcctgcacccaggtgaaataaacagccatgttgctcacacaaagcctgtttagtggtctcttcacacggacgcgcatgaaacacacgaccgcacttcaggctgggcgacagagctagattccatctcaaaaaaaataaaacaaaaaggagtcacctcccccgagaggcctctggaccaccccatctgagcaggccactcttccttctctatcttaccatcttgtttctgtcccagtagttagggctacctccagtaatcctatttgtccctttactgtttagtgcgtctcgcttgactagaagctccatgaaagcaagagaccctacctgcctccttcgccactagacccccagggcctggtatgtggtgatcgctcagggcccattttcttcctttcctcctcctccaagggtggggaaagagcatcagaaggtctaggtggccccaggcccaaacaatgctcctttaaaaggaaaccagattgttacaaaggtcagaggctgaaaagttatttccgccttttatccctctaaattcttcacttcctgaaaaaacaaacaaacaaaaaagccactgagggcccttggactaaatccaggcctcagttgctgggcagaggtcagtcttgtccagacatgggaaaaaaataattcgagtcagacaggtgggtcaccagagaacgaatccagcctgcaaatggcctgtgcaatcttcagctctgtccagacctgcctccctttggggatgcctttaaaggtgatgaatgatctggatgaatgggcttagaagataagagggaaaaacaaatatcacaggtcaaatcgttatttgtcttcaagtttaacaccgtctactggactaaaagatgtccaaagaatagttgttcaactatgtaaattcctttttttctttttttttttttttgagacagagtctcgctctgttgcccaggctggagtgcaatggtatgatcttggctcactgcaagcaacctctgattttagtattgttagtacagacagggtttcaccatgttgaccaggctggtctcgaactcctgacctcaggtgatccacctgcctcggcatcccagagtgctgggattacaggcgtgagccaccgtgcccggccaactacataaattcctaacaacgtatctccagaaagtataggcacaacagcacatgcagtcattcctgtaattaagtgctccgggaggccaaggcaagaagatcccttgagcccaggagtttgagaccagcctggacaacatagcaagactgtgtctctacaaaatatacaaaaattgggctggggatggtggctcacgcctgtaggcccagcactttgggagaccaaggcaggaagatcgactgaactcaggagctcgggaccagcctggacaacataacgagacccagtctctactgaaactcaagaaaattagccagacgtggttgcatgtgcctgtagtcccagcactttgggaggccaaggtgggtggatcacctgaggtcaggaggtcgagaccagcctggccaacatggtgaagtctcgtccctactaaaaatacaaaaattagccaggcacggtggcacacacctgtagtcccagctacttgggaggctgaggcaggagaatggattgaacccaggaggcagaggttgcagtgagccgagatggcaccattgcactccagcctgggcaacagaacaagactccatcaaaaaaaaaaaaaaaaaaaaaaaaaaagaaagaaagaaagaagaaaagaaaattagccaggtgtggttgcatgcacctgtagtcccagcactttgggaggccaaggcaggaggatcaatcaaggctaggagattgagactgcagaaggaaaccctgtctctaaaaacaaggtccagctaaaatcagggtccagctccaccacaagcgcagctccaggggctgttgagttttgcctctaccattccaagtagtctctgctccagaccaagtcccaccatctggcagtcatgtcagtctaaccacagtcatatcagggcgcttccagtcattgagtgccccttgaggaggctggaggagaggccaatgacatttgcacttgagactccagagtctagatttataaccactatgttatggctgccagtgtggctgcaaggacacttctttcattcattcatttacaatagatgtagcatctgctgtgtgccagatgccattctaggttatagggaaacaaggcagagcccctgttttccaaggcatccacattctaggaaagactgctaccagcctggcgtggtggctcatgcctgtaatcccagtactttttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaagctaaggcaggagaattgcttgaacctgggaggcagaggttctggtgagccgagatcatgctactgcactccagcctgggcaacagagtgagactccataaaaaaaaaataataataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagagacccaacaggaaaaggaagagactgctctatggccaggcacggtggctcacacctgtaatcccagcactttgggaggcccaggcgggcggatcacgaggtcaggaaatcgagcccatcctggctaagacggtgaaaccctgtctctactaaaaatacaaaaaaattagccgggcgtggtggcggatgcctgtagtcccagctactcggaaggctgaggcaggagaatggcatgaacctgggagatggagcttgcagtgagccgagatcgcgccactgcacttcagcctgggcgacagagtgagactccatctcaaaggaaaaaaaaaaaaagaaccaagaggtgtccaggcgaagagaacagcagatgcaaaggccctgtggcagaaacaatcttggtatgctggaggaataggaaggcagccagtgcagctggagcaggataggttaagggaggatcaaggtgatgagggcctggaaagaggggctggggtcgaatcaccagatcctgttggttgcaatggaagagcctggagtttattctcagagcagtgagaagccactggaaagttgtttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacatgccaccacacccatctaatttttctttttcttttttttttttttttttgagacagagtctctgtcacccaggctggagtgcagtggcgcaatctcagctcactgcaacctccacctccctggttcaagcgattctcctgcctcagcctcccgagtagctgggactacaggtgcatgccaccatacctgggttaattttttgtgtttttagtagagacaagatttcaccacgttagccaggatggtctcgatttcctgacctcgtgatctgcccaccatggcctcccaaagtgctgggattacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctgcctcagcatcccaaagtgctggattacaggcatgagtcaccatgcctggtcacacttctcattctttaaaccagacctcatttgtccatctcccccatcccccgccccaccccacggactgtcctataatgcccatacaacaggtcactgtttagaaagtgctacaaagttacaaacacagtcccttctgagcctcccaccaatgttggtgggtacaaggtcaaaaaaaaaaaatctcatctatctaaggggcataggagactttttagttagagggcccaattatagtcctcctgaaaagatgccaaaagtccccttcaacacttagcaaagattcaagaaagatgaatctcacattctttgtatgggaaatgaggaacttgacatcttcaatataatggattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgggaacaatccaatttgaaggcctcaatgcccaaatctacactcttgttttattctatatccttggtttcttttttttttttttgagatggagtctcattctgtcgcccaggctggagtgcagtggcgtgatcttggctcaatgcaagatccgcctcccgggttcatgccattctcctgctgcagcctcccgagtaattgggactacagatgcccgcccccacgcccggctaatttttttgtatttttagtagagacggggtttctccgtgttatccaggatggtctcgatctcctgacctcgtgatccacctgcctcagcatctcaaagtgctgggattacaggcgttagccaccgtgcccggcccacacctaggtgatttttaaagttcttctagtagagacagggtctcactatgtcgggtcgccgtgtttgatgtcagttttccctgccagaatctacaatctccttgatcaccattatatcccaacgtagagctcagtacctggtacaaagcacatttgatcaatacttgctgaataaagaaataaaaatgaagaggcactccagcctgggcaacagagtgagatggtctcaaaaaaacaaaaacaaaaacaaaaaacgactggaaaggagatgagggtacttgtgaagccatattatatgacacgctctgtgctaggacttttatataccttgtctcatctcttcatctcatataatccttacaaggatctcaaaagtggggaaatccccatataactgaagacgaaggcagttcagaagttcactgatttgccctaaggttcctcaatttgcaaacgtcaggccaatgatccaaccccaggtatgtttggcagtgaaggaccagttgagtcacagctgcaagtaaccaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttctgttcagaacacaaaaataagtcgtacatcttcattaaaaacgggtgaagaatttgaacaaacatttgcaaactaaaatacaaatgaaatacactcaacatcattagtcatcaagaaaataaaattatgagataatcactaataatcactacatatgcaccacagtgattaaaatttttttaagttaagccacgtgacccaacaaggtgcattcactcaagagaaacgcaaatatatgtccactcaaagacttgcacatgaatgttgagagcaggtttatactgaatagcgcaatgtgaaaaaaccccaaaatctagcaaaggatgaagggagaaataaactgtggtatatacatacaatagaacactactcaataataaaaaggattatattcctgatacatgcaatatgggtgaaccgtaaaaatatcatgctgagcaagagaagccaaacacaagagaacatgttgttatgatttcacgtacatgaaactttagtaaagacaagtctaatccatagtgacagaaagcaaatcagtaactgctgacaggggcaaatgaggagatgatctcaagggaaccttctggggtaagatgctgttctgtatctcgatcgtattggtggtcacacaagtgaagacatgttagaactcatcaaaccatacacttagaatgtgtaatataaacctcaataaagcaaaattaaaaaaaaaaaaccacctttaattttctcttacaaaaaaaaaaaaaaggaaaaccacttaactttaattttctccaacaactgattctggtacacagtataccttaatgcctgcatccacggcctcacgtcatgctgtttacatgaacgtaaagcttcgccgaagagtggaataagacagtcctgccagagaaaaaccaaaattactcaacgtaaaacaggctgttgatatgtttgcagatatatagcaagtcttaagtccaagactgcaatatagtttggctacttcagattgattgcagtagttttatctattacactatacccttccatcatttatcttctactcacaagaggcaagcacacagtaagagaaagccttttgttttgaagggaaatcttcttcagaatattaagtctaatttatcaatatacttaataaagcacattacaaaaaaaatgtcacagcacatttactataaagcagactgcagaaaaacattacaactaatgctttattatgaagttctcgaagatcaccattcattcagaagcccccatctctggtcgaactttaccccatttaggatgaagaggagagatctttgtttgcagcaaatctaaaatttacgtaatccgcctaaaggaactgtctttacatacaccacctcccaccccaaaaatagaagaaaaaactgagcaatttgccatccttgcgattatctcaggttcttccatctgccccatgtacttcccaaatgaaagactgcctgaaaacggcatgttagatttctggatttaccagcttgcccaactacaaatcctattccaaaaaactcaaaaaataaggtctttgttctacagtaatgaccattaatagtcataagagtgtgcttgtaaaaatatacagacctctgttgaaagtctgttagaaactgtggtctccaaagcaaacgagcaatacagctacaaggtacttagaactggcaaagactgtgaaactgttaaagtagaaagtctcagaggtccaatagtgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatatcagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttacctccgtaagagtaaacttactcagttatagactgccacttctgatcttgttctatcgggtttaaagcagttgccaaacaaacagaacttcttaacaatggaacttcaatggatttctgaggttcccttggatctggacttcacatgttacgaagcagttttttcatgtctacagaagttaaatgaaatgtcattaagttaatgtgcttttattataaattttgatttatgtttggcattattaagaactaatcaccaatgaacagctcctttaatatttcaggcagttaaacactataagcattactgagagctatataaaaatcatacttcatacaaaattactgtacctcagacccctaaaaagcagttgccttcaaaggctcaaaaatcactaagtcgaggtcaggtgtggtggctcacgcctgtaatcccagcactttgggaggccaaggtgggtggatcacgaagtcaggagttcaagaccagcctggccacgatgatgaaaccccgtctctactaaaaatacaaaaaattagctgggcacggtggcagacacctgtaatcccagctactcagggggccgaggcaggagaatcacttgaactcagagggcggaggttgcagtgagccgaaatcgcgccactgcactccagcctgggcaacagagtgagactctgtctcaacaaaaaagaaaatcggtaagtcaatctactatttaaggggacaaatctagacctgcattagcaagtcttgctcaatccagaatactcattaaactttttaataacatcttatcaagtgttccatttgtgataaagaacttaatgagccacatcaagatgaaaatcaagaaaaatatttagctgaaacactactttgtcctttatcaaacaaaatggctagataaatctcaaagtattaaggtggtcattttttttatttgacttaattttaagtgcttttcatttcccaaatcaaacataaatagggcagccctaaatttgttgcttcacatgggattctgcccccacaaaaatgtaaaataacttccagattttccagtaaaatatactaagccaaacattttgagcaacttgtccactaaaataactttaaaactattttctcaaatacctacctattttttcttttgaccctccagcaagtagattgatattttctcctggtaacaattctaattgctcggtacatttgacaaattttccagactcaaagctgcttaatgatctgtaattaaaatattgcttagcttgtattcctatgcagcctgtggaaccattaaaaaaaacaaacaaacaaaaacagaacaaatcctaggaagacagcaaagtacacagcatttttctgacaaaattccttccacgaggatgccattattttggtttttatgttgaagatgtgactaccacttaattagtactcaaattggagtggcaaaccagaaagtcacagctacagactttcagtggagctgactcgcccctgtgtctccttcctgttttcatgtgttgcagcctgttctcttcagagcctgacacactgacagtagacctctgcaggacaactttgacacccagttctctccaagctgccagtgagctccctgtgcagcctcactcctcacctacagcatgagcccttgcagctctcccagcatcacaatcttgtatctcagtcctggcttctttcactgctggcatccctctgtctctccctttttcacctacttttcttttttcaaagaattcttctctttcatctgcttatatgaaaaataatgacacctctgaaattctttcctgtagttctgcagcatcaatgccaggaagacaggcctcatcctcccagcttctatgctgctcctttcagatcccttaccctgtccccattttcatgacacgggctctccagccaggaagaagacactgtttctcactctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacagtcatcatttctgccattaaaaggtcctaagtcctctccagtggcaggttccccaagtccccactatgctctataatgccctatgctttcagctaatgactcagtcctcagaaaaaacaaacaaataaacaaaaaaacacaggctttaatttcctctacccctacccccaatccaccatacactgccgaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatttccctccagcaacagcttcctatcctcgacttcaagaaaaactcactgaccaaataacttacctcaagcttttcattttcaaatgtctctaccactcaatactattcaatctagcttcttctgtctctctacaaaactctttttccttataatccctagagcatctgacaaggctgactactcccatctggatgtcctatatctagggcacttcccttctcaatgtccctgttatttttttgaatggcttcctcttctatcctttcacaaaaatgctaaactaggattctgacccaggccttccttcctcttcactcactattctccagaggcttctctctggtttggttgcttacaaaggctctagagtatagagactgaaaaggaaagagggccttttctgtgtactaatcatctgcaaatctctcaagcttagactgtctccttagttcaaaatccaattcttaacagcttacccaacaatctcatctgcacatttcattagaaatcttaaaacatggcttgttctctgtgtgctcctactccagttaatagcattgtttctcttccctctaccattgcccccataaattaatggtctccatgcttccatacttgccccgcacctccagtctcttcaccacagcagaatgaaccaagtcagatcacaacacatctctgttcaaatcccacctgaaattttcagtcttactagaataacagccaaagttcttctcagttcccagctacttctctgcccttatatcctactgtttaaggcgctcctaaacacacaggcctcccagctatttccagaacactccaagcccatcattctcacatcaggtctaggcccaaagggcatcctgatgggcatgtcttgaccttgtgtcttccctccaaagaaggtcagctttacctaactgctttccttatggcacagaaaaggtgagtgaggtccaattagtccttctatcaataatctttatctaatctttgctttaaaaggttggaatttgtgtctgttttatgtgctgcctgggtcacagcacatgctcagtgaagcaattacacattaacccatttagcagtagaagtatcagacaaagtctaatgacctttatcttcccagccaagtgtctgcaacagagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaagcagtacaaatttttctttatattcactctggcataatcttcaaactgtattaaggttttagaacaacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcgtagttattggaaatttgttttataactggaaacagaaagccttactttatatagttgaagtcagctttcaggttgaaggaagtgctactggtactctttttcaagtcatggatagcgttctgccattcctgcacagcagcccaatcggcaattgagatgtagcactcacatgctttatttcctaaataatttataacctcaggggaagagtcagtcggtttggacagcacagtttttctggattcacctgaaagtattttataaagtaagaagagagagattcagatcaattagaaatatttcaaagagcacagaaacctaaaaacatgataagatcatcagtacgaaatatattactataacttttgctttatttaaaaatactgaacgctcaccattcagacaatgtttcgggctggcactgttacacccagcattggctaaggtgagcaccgatttgtcaaagctggagatgcagcaatgaacacctatcatggcacacaggtgttcctggtactccacagaggccttttcaaacctgaaaagcaaattgaagcagtcttatttctttatttatctacttacttactttttttttttttttgagatgaagttttgctcttcttgcccaggctggagtgcaatggcactgtctcagctcaatgcaacctctgcctcctgggtacaagcgattctcctgcctcagcctcctgagtagctgggattacaggcgctcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcgcctggcctttacttacttacttacttgttttttgagacagtcttactgtcacccaggctggagggcagtggcatgatcatggctcgctgcagccttgccctcccaggctcatgcaatcctccaacctcagcctcccaagtagctgggactacaggcgcccaccaccacacctggctaaaacaaggttttgctctgttggccagggtggtctcaaactcctggactcaagcgatccgctcacctcagtctccccaagtactgggatttcaggcgtgagccaccgcgcccagccccaaaggaggctgttattttaaacacacatatctcatttcccccctcccacaaaaaatggtgcaagaataaactgagctaaaacagtgagttgactatggtggggggaggtttgatgtcttcctcacaactatgaaactaaatttaaaagtggttaaatgttttttaaaaaatgtaagagtataaaagaactagtggaaaatattgataagtaactgatgtcagtgtgtggaaaggctttgtagaaggataaaatgcaagaaaagatgcacaagtaacagcatctagatgcataatgctgaaatacaacactaaacattaaaaacaaattataatcaagaaattggatagcatcaacaatcttagtatttaatgaaatttcacagattaacacaggaaaaattgagaggccatgaagacatgatccatgttttaaaaaatcacaaatggtcactatatggggcaacttctactattagtcattaatacatatagaaatgtaaagtacaataactattttcgctgatggtggtggcagcattcttgtttctcagtgactctcagtatccacaaaggtgaagggaagggggtactctattattaagggtatacattgcagccatcttttctgtagagtaacttagcaatagaatatatcataagacttatggtttggcagcctttcttctagtaaatcagtttatgagaatggattccaagaaagtaatcagaaatataagcaaagatattaagtgctatggtacatttagtaaaaaaaaaaaaatcagaaacaaccttaatgcccaacagtaagaaatattaaattatggtacactcataaatacaaatctttattaaaaataacactgtagaatacttaacatggcaattttttttttttttttttttgagacagagttttgcttttgttgcccaggctggagggcagtggcacaacctgggctcacagcaacctccgcctcccgggttcaaccgattctcctgcctcagcctcccaagtagctgggattacaggcatgtgccaccacaccccactaatattttttgtatttttagtagagacggggtttcaccatgttaggctagtctcaaactcctgacctcaggtgatccacctgcctcggcctcccaaagtgctgggaatacagatgtaagacaccgaacccagcctacctaacatggcaaattttttttttaaatattgagtgggaaaaacagatcataaaaccatgtgcctatgtatgctgctgttttggtgaagaatggagaaaacgacatgaaagaaaaaagaattacaaagcatatggatatggaaatatgggactacaaaaggacacacaacagaagttactacaaagatatggaagaatgagcagttcttttattttcctaaattcgcaagatttcattaaactaacataaatggacacagaatattatggtacaagctcctctatctggaggaagcaatgagtctgaatgtagagttcacaggactaatgagcaaatactctgacaataaagggtaatttgtatcagactctgagggggaaggagctcaactagggatcaagttcaaaagcatttataaaacaactgacaggtcttgtttttcagtgtgatttgccactaattcttaaataagaaaggcactcaagtattgctgctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctatcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttacttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaatgttacatataaaatagccacaaagggtgactaacagaaccttagcagcacatggatgtttgcacccccaccccaaagttacccaaacatttaacctgtgacctctgtaggaataacacatggagtaaaaagaaagcaaaaattaaatataaataaacaggaattaaagaatgattaacttcatgtgtttgaatactgcttgacattacctgaattgctaaacattttgttatttttggattccagttatttattgtgagcccactttcaagccaggaattactcaagcatttgtcatacgttataaaaacaatttctcctggccaggtgcagtggctcatgcctgtaatcccagcactttggaaggccaaggtgggcggatcacttgtggtcaggagttcgagaccagcctggccaacatggtgaaaccctgtctctactaaaaatacaaaacttagctgggtatggtggtgggtgcctgtaatcccagggactgaggcaagaagaggcttgaacccgagaggcggagcttacagtgagccgagatcacacaactgcactccagcctgggcgacagagtgctgtgtctcaaaaaaataaataaataaataaaaaatttcccccataaacaaattttcagaattacctttaaagttctaaactttgcacataagaaatatagttttaacatgttctaagatgaatattgttttaacatgaacaaaaacatgaacattattttaacttctaacactgttttaacacgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcgattggtatagaaaaaagttctagtcactttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcatggaaaccaaccttgggaggtgaagttaatgcattagcacatccctcgtatgcattatacattaatttctccagatattccagatactgcagaagaagaacaagtctaagttggttgttaccatggccttcatcactgtctgcagttgtccactgactaacatcctgatcagggtttaatgtgtgagctgcgagacttcgaatgatacctgaaagcaaagacaacattctgaatttttaaaaatcttaaaagttcctagaataagtgtgagttttttatgatcaattcacatttatcaagtatcctctgtctacccatcatttaaaaataaaaaatcccaacatgaaagatctttcattttaggggaaaaaaatatatattttttccacacaactcccataagttttgggaaaaaaacaaacatatttccaatgcaattattcaatgaaagcttattctaacaaacatacctgaaaattactgacttcttttcaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatacggcccactgccaaaggatagcatctgtcttcaggagattgcgtggaattgttgactggtcatgcttatccagtctctggcagctatagaacagtctttccaaccaattgtccttcctgggaaaagtagtttcatatttaaaagacaatgacaacttcattttaataatgaaaaaaaaatgcaaggggaatgggaataaggaactgtaattttccctactccaaaaaaaggcaaaacctatgaaattgagaagcattatgtcccccccctcttattttgaggtcttttatagttaacaggatgaggtacagcgtggaaggatgattagggtaaacggctcatgccggtcaggaatgaaactcattcaatgcaactaagcatctctagaatatctccacccccaccccattccccaaagtgttaatgacatcacatcagttaactgttaaccacatttcattactcaatttcaaagcccatttttgtttctacagatgctatcttcaaagtaattttcctattgatgaaaactgaaataacccatatgagaagaatgttacttgatactctgccacccccaaacatattttctcttcaaaactgcatgtaaagtaaagggaatcttaaaattatctttcctagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaataaagttgttgttacgcaaaatattttagcttaaaaggttagcacatactgtaagtggattatttacttattaactcactggaggtaaaaatatagaaaaattgagactttcaaatggatacggagatgtgattacaactttagatcctttttttattcacttcagatgggtcatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaataaaagattactgtttagtttttcaaatatctgagctactaagaaacatattttggcactacatgagttattctatactaattattgtgagcctataaagctcattaaaaatttttaattttcttgcagacctgcaaaatttgattatttgacatcacttcaatcactgacaagcagggccataaaagatgtgtcattaatgctctaataggtgatctgtcttctcctaaagtagacaaccagtagaggctgtaaatatcacagaatgtctttgctccaaaacaactgttataccttaggataacatctaaaggaattgatttcaacagttttccaaatgcttgtcgaatacgagttccacagtgcactagttgaacatggcaaacatcaacacatctatgaaagaacgaaatagacaaagcaggtgtgttaacatttcaaagttattaggattaatgtcaaaagacatgatcttaatttcatacctctgtaaaagatcatctggcaaggaagaggacagagcaggtagactgctgcatgcctgcagacagatattcacatcttcaacgagaactattaaacattaaaagacagctactttcagctggccaaaagaaattatatcccagtttgtcataattatctgaatccattcattcattcaacaaagagtgagtgcctactctagactaggcactgttcttgtccagaatcctcattgactgtcatgtttggaaaaatgacacattcaacaaaacccacgtaatgtaactgatgggtcatcacacaaaactttttctgagagaaaatgtaaaagtatatgcaaactataaacattcacgtaagcttaaaaatgtgacaatcacttcaaaacatttttctaatactaagaatgaaaaaaaatcaagactgtgtatctgtcattaaaatgaggattacacatctgcaggtcaggaaaagagctctattgatgaccatctcccattaccaaggattgataaacaaaatagaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacattaaaaacaataacaaaaacaaaaaaacgttaaaagcctagtcttcttacattggttttctcttggtttttcaaatatctcaaacaataaaaaataaaaataaaaaatgaaactatagaaattactgtcaaaattgttgtgtgccttttaagaaaacctcccaacgcagcatgataatagcaaagaggccgggcgtggtggcttacctgaggtcaggagttcaagaccagcctggccaacaacatggtgaaacaccatctctactaaaaatacaaaaattagctgggtgtggtggcgggcacctgtaatcacggctacttgggaggctgaggcagaagaattgcttgaacctgggaggcagaggttgcagtgagcaaaactccgtctcaaaaacaaaaaaagcatagaatattaaaaatctatatatattcttctatgaaacactgggggtgggggattgaggtttttcatgtatttcttttcagaaagaataagaaagcctagattaaataataaaaccaaattataaggtgtttgacagtaaagaagctgctctacctcacctctataatccacattttttaaaattttttgtaattcacatttcttattctcaaattataaaggcaaattaacaaagttaggaatagttaatactatataaaatctgttacctcgtgtcctggttaaggttatctttcttaagtaatattcacagaagatttaatataattgagaaatgtttctttgtggccgtagttacagtgctaatcacagctccatcaaacaaagaaggagaggaagaactgaggctactagagataaagtgatcatgcctgaaagacaaagcatagattatcttttcatctttaatcaaagaaagcaagcaagtccaaagttaaatcaacatacatctttaaaatctatccattaaaaaaataaaatgttttgtggggttcttaagaaaaatttgtgaatacagtacctggtacaatgagaatacaatgtgtagagcacagcatactgaatggcagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggactttttttatttggacatttttaaattaaaattacagattggaagggatctagtacactacaccttggacaaatacttttttgtgaagtcagtaaagcctttgcgtgcaatatagcatctctatgcaatgcagcaactccttgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccccatctctactaaaattacaaaaattagctgggcatggtggcgcacacttgtaatcccagctactcgggaggctgaggcaggagaatcgcttgaacctgggaggcagaggttgcagtgacccgagatcataccaatgcactccagcctagatgacaaagttaagactctctctctcaaaacaaaacaccagccacatacgaaacacaggaatgagagtacctgtgttccaagaaaactttcttgagtcggagtctctcgctctgttgcccaggctggagtgcaatggggcgatctcagctcactgcaacctctacctccggggttcaagcaactctccctgcctcagtctcccaagtagctgggactacaggtgcccatcaccacgccctgctaacttttgtatttttttagtagagatagggtttcaccatgttggccaggctggtcttgaactcctgagctcgggtgatttgcccgtctcggtctcccgagggattacaggcgtgaaccactgcgcccagcccaacgagaactttctttacaaaaacaggcactagtgttgcgatggttgtacacttctgtgaatatactaaaaatcagtgaattatacacttaaaataacaaacaaaaaacaggtgctgggctgtatttggcccacggaccatagtttgctgatctctggtctaaacagagccctttgtatgtgccttttgcggaagtagactgtatttcttcaattttccatatactgcaaatggcaaggtgccctgttcaataaggaaacaaaggcacaccctgccactatacaccttttccatccatcttgttcctttacactgccaagacactccattccacctgactgccccagccccacccactttctccttatttctagagtacaggacataaacatctttgaatctgcaaataatgtgaataattttcctcaaaaatcaagctttcatgtttgaagaagagtttattgtgacttcaaacataagctgtaactggtaataagcgaagcagctatggaattatacaaggcaatccaatcaaacaacatggagcacactgaagcgcaaacatcaaattttacctttttcctcctaaaaactttattccctaattacatccattactttctttctttgtttctttctttttttttttttcttttgagacagagtctggttctgtagcccaggctggagtgcggtggtgtgatctcagctcactgcaacctccacttcctgggttcaagcaattctcctacctcagcctccaaagtagctaggattacaggtgtgcaccaccacccctggctaatttttctatttttagtagaggcgaactttcaccatgttggccaggctggtctcaaactcctgaccacaagtgatcagcccgacgtggcctcccagagtgctgggtttacaggtgtcagcaaccgtgcccagcctacacctattattttctattaaaaataatgtttttcaactctgtgtggtccaataggaagaagaaatacacaaaccataaacaataaatacaaatcaagagcagggccacgtcgaattacttaaaaaaaaaaacacacgggctgggcgcggtggctcgtgcctgtaattccagcactttgggaggctgaggcgggtggatcacctgaggtcaggagtttgagaccagcctggccaacatggtgaaaccaagtctctactaaaaatacaaaaattagcccgtcgtagtggcaggtgtctgtaatctcagctactcgggaggctgaggcaggagaattgctggaacccgggaggcagaggtggcagtgagccgagattgcaccactgcactccagcccaggtgacaacagcatgactctgtctccaaaaaaaaaaaaagctttttttttcccccctcctaaaagaaagactacaggttgagtatcccttattcaaaatgcttgggaccagaagtgtttcagactctgtatatgtttggatttgagaatacttgcacatatataaaatgagatatgtgggggacgcgacccaagtctaaacacgaaattcacttatatttcatagacgccttctattcatagcctgaaggtcattttatgcaatattttaaataattttgtgcatacaacagtttggactcatcacatgaggtcgggtgtgggattttccacttggggcatcatactggtgctcaaaaagtttcaaattttggagcattttagatttaggattttcagattaggggtgctcaccagtaagtgttatgaaaatattccaaaatccggctgggcatggtggtgcccacctgtaatcccggcattttgggaggccaaggcaggtggatcacctgaggtcaggagttcacaaccagcctggctaacatggtgaaaacccatctctactaaatacaaaaaaattagccaggcgtggtggcgcatgcctgtaatccgagctacttgggaggctgaaacaggagaatcgcttgtacccgggaggcggaggttgcagcgagccaagattgcgccattgcactccagcctgggcaacaagagtaaaacactatctccaaaaaaaaaaaagtattccaaactccaaaatcaaaaacacttccagtcccaagtatttcagataaggaatattcaacctgtatgaatgttcctagggaaaaaaagacagccaaaatataagaccatgtataagaactaacttcagtagacagaaagaaaaaagtaccaggggaagaaagagaccgcattttaaaacaactatacaaatttgagctgtaagaaacactgacattttctataagcatgctagagcaaatgggagaaattcataagacgttttctagaaaataaaactaatataaaaaaacttatcaagatttgtcaaggaaaaagaagaaacgttaaatataatggcaagaaaacattcctaccaattttatttatccaggcatgtcttaaatatggctgtttgttacatacagtgattctgcagacatgttgacatgacagtgaaatacataaatatgtaatgagaaaaggcttaactgtggataaaacaaagtcattacaattaaagactcgagtttttggcatttccagttgtagtcagggcactgaggtcaaatttaactacaaattttgcattgtctacattgaacacatgattcttaaaagcctcatgttttatttcagaacaggcctcaggaagttgcagactgtgcaggaggttgtttagggcacaagtcatttctcccaatattaacttataggcagtctccaaaacaggaatattcttcaagctgagcattgcttgataaacagcatgggctacagcaacaacctgaaaaacaaaaaattcaaggaagtgataaatggaaaataaatcttctaaaattatatggaaaataaatcactatctgtattagtgctgatgatacaaataaatttaagattgatcaattcactgtccgtagcacttaatattttaatttttaaaaaaccaatcagaaaactgacacagatcagtaagctatttcaaatctattaagttttatcacaaataaagagtactataaatgaaaactgtcaataggaaatttccaaaatggccgtttttttttttttttaaataatcaacatcaaaagacatatgcaaacagcagtttaagactgggtttcttaaatctaccaggaaagtctgtggtggatttgactagggggtggttgaaaagccagtcatttttgtttataaaatatacagtacttaatttataactttataaatgtgtcaacttgttttacccttatgaaaatttaataaatttaataacagcaagagatgcataatctgaaaagagtatctggcacatcattcatgaaagtattcagtatgattatcaagaaatataaatttaaaagaacaaatacaatcactatattctaaatcaaacatttcacatttcactcaatttcacttatatagcctggtaagcaacattaggtccaactcttcagtgactcaagttgtcaaaattcattatcagtatattacttacctctttttctttatgataacgcaagaatagtagtttagatgatggtataaacagtttttctacaaatgatgatggcagtttcgtatttatctgttcaacaatctaaaagaataaaatttttaaaaaatgagcttctcaaattacaaaaagacatggagaaaccttaaatgcacactggtaagtgaaagaagccaattgaaaaggctacatactatatgactccaactacatggcattctggaaaaggcaaaacgatggagacagtaaaaagatcaggggttgccatgggcttaagatggagggagggaggagtggggagagggaacgaggaaggagtgggtagaacatcaaagatttttagggaagtgaaactatcctgtatgatactggtaataggggatacatgtcattacacatgttaaagtccatagaatacataacacaaagtaaactataaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacgtattttacagttatcatgggcattttttcacattagcaaagagaggtgtaaatctggcagaaatgctcagcagaatgtcatctagaatttgctttaaaataatccagctggagatgaaaggatagcaaagaggcctagatgaaaccagatgggccatttgtttctaattatagaagctgagtgttaaatatgtacaaatttattataccatgctccctatttttatgtgcttcagaatgtccataataaaagtggggggaggatatttatggttaagaaattaaaggaggccggccgggcgtggtggctcacgcctataatcccagcactttgggaggccaaggcaggcagatcacgaggtcaggagatcgagaccatcctggctaacatggtgaaaccccgtctctactaaaaatacaattgtgccactgcactccagcctgggcaaaagagcgagactccgtctcaaaaaaaaaaaaaaaaagaaagaaattaaaggaggccaggcatgattgctcacacctgtaatcccagcacttcgggagggcaaggcaggaggattacttgagaccaagaatttaaggccagtctagacaatgtagtgagaccccttctctccaaaaactacaaaggttagccaggcatggtggcatgcatctgtagtcccagatagtcgggaggctgagtgggagaatcacttgagcccaggagtttgaggctgcagtgagctctgattgtaccgctgcactccagccaggggaatacagcaagatcctgtgacaaaaaaaaaagaaagaaagaaaagaaaagcaaaaaagaaagaatctggtgcatagagcaatgtttcctcagaaaaaacgagtaaagctacactgagactagctatcaaccactaaaaatagaggcctggcagagtggctcatgcctataatcccagtactttgggaggccaaggcaggtggattgcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcctgtgcaacagagtgagaccctgtctcaaaaaaaaattgcattaaaaataaaagtaaatagacactaaaatgaaagcatagattataagactgatgaatgtactctaaaaaataatataataaagcaaagcccttattttttttcttttttggagacagggccttttttgtcaccttggctgagtgcagtggcacaatcagagctcacttcaacctcaagttcctgggcttaatcgatcttcctccctcagcctcccgagtagctaggactgcaggtgcacaccactacaccaagctaatttttgactttttgtacagatggggtctcactacattgcccaagctgtgccagaattcctggatgcaagcaatccttctgctttggcctcccaaagtgctgggattacaagcatgagccaccatacccagacaaagtccttaatttcttacatatcgatttaagggcctgaataaaccaacacattaaaaaggaaaagaataattcacataccagcgtgagtaaattcaagactgagatgatataattggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaacctgtaaatggggaaaacaagcagctttttacaaaaattcacgtgcttccacaaagcaagaaaatactttttatttaatgcaatttcaactgaaaattaactgcttgccttgccagcagtctcttaatattctagttctcagtagctgaataataatgatccctttactacaatatgtaaacatgatcttggctaaaaaatcctaaagtgctactatgacaggaaatggaacctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaagtttctatctactgatggtctcttttgaaagataagcactctcatgcttaccacataatatcttcaaaaatcatattatttccaatacacacacaaacaaaatcccccacttaactataatggccaataattgtgtactaaatttctaataaaatgggggagaaaacagagcaaatgtttaaaaatatttctataatatttaacaaccaatacatacaggattttatttagtctacccatagttttcattaaaagtatccttggaggttgggcatagtgactcacatctatcatcctagcactttgagaggattagctggaaggttctcttgagtccaggagtttgagaccagccatgtcaacataacaacacctcatctctaccaaatttgtttttaaattagttgggcgtggtggctcacaccagtagtcccaccaactacttgaggctgaggtgggaggatcacttaagcctgggaggtcaaggctgcagtgagccaagatcgtgccactgcactccagcctgggcaacagagaccatgtctccaaaaaaaaaaagagtgggggagagagggcggagggggaaccattcttggccatgcatgcacagtggctcatgtctataatcccaacactttgggaggctgaggtgggaagactgcttgaggccaaaagttcaagaccagcctgggaaacactgagaccccatctctacaaaaataaaaaattagcaggagctgtggtgggaggatcacttgagcccaagatacagaggctgcactgagtcgtgatggcaccaccccactttaaaaagaaaaacaaaaaaagctgggtatggtgacacccgcttgtagggctgagtgaatgggaagttcacctgggcccaagagttcaagactacagtgagctatgattgcactactacactccagcctgggtgacagagtgaggctccagctccaaaaataaataaaaaaaataaaaaccccaccattctaccattctcaaaggcctaaaagatcctcataaatcaatatacacctatcctataaattatgtcccttttattttatgtctgaattaacggctttttatttcaactctgtacagtcttcaaacaaccaccttttagacattaaaaatgaagcaaagatattaaaccattttgaaaccatattggtttaaaataccaatatgctggtttcatttatctttaagttctgacatttctgctcaagtacacaacttactatataatcaatatcctattttatttagcaacatgttcagcaaaagtatatgctcctaaaagcgagttttatcctaacagtaaaattttcatcagttagattaaattttttatgactgtatcacacatgcttctttctccttattcaaagcagagtacaatgcctggggttcacttcttgtgtcttttccactgaaccctcattggatgtgctatatacagtgcagctaatgtttgaggctgctgaagtgtggcaatctagctacctcatttttaatttgtttatgttctttgatatcaggctatcaaagaatataaagatatacaagttttcatatgagttccatcttatgctcagagaaggttactttctgaggcttctcctatagtgtgctattcgtaatatgttgaaaaactaaaaggaaacccaataatttaaaagtaaaattataagatatattatttaaaaatgaaagaataagatttaaaaattcagagtggccttttgtcatgggagggtaggggagttggatgaaaggaggatgagatataacaggattccctgcttttctggttatttaagaaagcagtcagacaatatatacatatatacatacatacacacatgctaaacaaatgaaggattaataacagttcacctggtaaagagaatcatttacaatgtaaaacaattttatttttgaatgacacttcaaatgcccaaaagcacttacaactgttacgtatgcctcagtaattggaggacccgaattgggctgaagcgttccccaatgctcctcagcacagtactaaatacccggagaagcgcagccagctttggtgatgacactgatggaggagggacgtcttcatccactgattccccagaggccacatggctgaggtcctagatgtgaattcacagcattcttaataagtagtacattgtttaaaaaaaaacaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggatactagaaccaatgtatacatctacctaaaattaagcaccaaaataacagaagagaatgagatcttaaggataacaaggggaaacatctctacaaactagaatgtgtggcttatgagaggtagatcagctttaaacgtgggctgtgaaaaaagacattctaggtgtgggggcaaagaaaaaacaacgcagaagcaaaacatttccttgcttttctaggaaagagtaaacacatcagtacagctaaaggtactgaattcctgttgactacaagcagcaaagatgaaaaaaacaagatgaggccaaaatctttatgggagccttgattggttgatctgaataggggagaaacacaaagagattcagataagagatggcacagagttaagccatgacagtgcggccagaaaagccaagtaccagtaacagaggcttcagcagcgctcttaaagctcctatgctatattcgtacagccacaaaagctggctgaagccaaggcttgtcctccaaagtacgattcaagttctcctgtacatatgtaagaggaaaatctttaggagcttttggtgttttgtgtttttttataacacaacatcaatttgctttaagactctgaagactggggacaaaaaataaaaataaataacaaaaaatgtctttagaaaaataccagctaccaagagtatgtaaagctttgcgaaatacgaagcttgcaacgtttcttttagtctctccagtaattctcctggtaatttaaacacatctgaaataaatgtttaaaatactgactgggcacgggggctcatgcctataatcccagcactttgggaggccgatgtgggtggatcaccagtggtcaggagtttgagaccagcctggccaacacggtgaaaccccgtctctactaaaaatacaaaaattagctgggcgtagtggcgggcacctgtaattccagctactcaggaggctgaggcaggagaatcatttgaacccaggaggtggaggttgcagtgagctgagatcgtgccattgcactccagcctgagtgacagagcgagactccgtctcaaaaaaaaattttttttcaaaatattgcgatgggcttgtaatttctgcttaaatgtcaggaggtctgagccattttaaaataaatctagcacaattttaagattttttcttaaccaaaattttaagaaacagctttctatatactcacctcagcatatgcttccatgtcttctagaaactgaccaagaagagtcgtaggaaatgcaagatcagctacccaaaatggctccaaactctgcaaccacccttggaatcgtataagaaattgtgaaagggtaggggggagaaaaaacaccaaaaaatccaaattaaaaaaatataagaggctcgttttaaaaagtatctggttttcaagcagcataccctaaaacatgtcctatatcataaaattaagactgctaaacatgctgatcacgattaaccaatacctctttaatacctctttaatttctgcagaaattaacttgtaaatgttatttccttactttttcagtaaatttcatatctatattgtcactacacatgacttaagactaaaatgccacaatctaccattggcctggctaatcccagggccacatctaaccattaaaggtgtatactcatctcctcagtgaaaatgaaacagaccactatcacctgaatatcctattttcaaaagtttattacaccaagtaagttacgagaaactatgacacttgaaacaagctgaaatgtgcaaatgagccacgctagtcattcacttaaatccaaaaaaatgggaaacaaaaccatttctcatttatgacaattctccaaattaaccctatatttccttttttaaaaaaataaccagaaaaacaataaaatgtgacaaataacttggatcttccattgtccacttcagggtattgccactgcaatatattcttaccatatactttcctaccagtacaaactacaaataacttgggtaagtcctgtctgtacttactctacccacctactagtaatttcctctgaaaatatatatttagctaacaagtcacgttcatttacaataaaacatttctctgaattagttttcttgcattattaaagaaatggtattggccgggcgcggtggctcacgcctgtaatcccagcactttgggaggccgaggcgggtggatcatgaggtcaggagatcaagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaagaaatggtattgatagatggtcactgggggaccactgctcctccccgacagtatttaaataactggtataggctgcaagacttaccagatacctgctgcgtgagcgaaggtttctgagtatgatctctatgccatccaactaatatatcaactgtatccttgatggaaacaaagagagagggggccaatcattttaagatattactgccattcacctgtggaccatttcacagcaaaagatcctaaaaggagcatctatgttctacctacttgacattctagaaacttagaaaggggagaggggcaggaaaataaaagaactacatttctgacaacaatgaaatagtttattttcttcaaatattttaaggtacgaacgtcagaaagaaaaatgcggcatttaaccctggaacctcaaatatcactgattatattcaaaggagcagaggcattgttttccatctgattcctcagttcctcacacacacaaccatccccctcaccccatgatctgaacaacggaatgaggaactcaccctaaaattagcgctgaaaatatgagggtaacatcgagccaccaaaagaatgcacttaacacatttgcaaagcaattctggtgtatccacattttcaagaattgactgcaggctggtcattacaagcttaaaaataaaagttacaaaccgtgaacattcaacaaaatagggagaaaacaagcaaattaggttcattatttactgactacataaaaaactgagtatgagaccaagaaaaatagattctgtagttttagttaaaaaaaaaaaaaaattcacttgtaaatcccaactgcttgggaggctgagacacaagaatcgcttgaacccaggaggcagaggttgcagtgagctgagattgcaccgctgcactccagcctggacaatacagccagagtccatctcaaaaaaaataataattaataaataaataaataaattgaaaatatttcgctccactaagatgttaagctaaaaacaaatactgctttctcctcttcaatgtttgttaatattagtcctttgacatcagttaacattagtccttaataacatctgtttacaatatccctaaatgctctctttaagattctacctgtgattaaatttcaaatacaaaaaagtaaaatggatttgggaaacttttctataaagtacaacaattactttgcaatccaaaatataaagcaaattttatataatttatgctttagtatattagtacttgcttcatattaaaattaaagaagatcagtatggcaccacacatgaataacatgcaggctcaggttaccattatacataaatttttaaaataaatatatggcaaaaataaaataataaataactatttgtcattccattgaaagaatatttattttgcagctgttaaaaaacatttttccctaaaaaaggaaaagctgcgctttacatagcaatcttataaaagaaatgctagaatcagaaaaccatcattttacgctgggtgcagtggctcacacctgtaaccccagcactttgggaggacgaggcaggtggatcacctgaggtcaggagttcaagaccagcttggccagcatgatgaactccgtctctactaaaaatataaaaattaacagagcacagtggcacatgcctgtaatcccagctactcaggaggctgaagcaagagaactgcttgaacctgggaggcggaggttgcagtgagccgagatcgcgccactgccctccagcttggacaatagagcaagattacatctcaaaaaaaaaaaaaaagagaaaaagaaaaccattattttgcaatagccaatgttataatctacacaggcacagactatcaatgctaaaaatcatttaaaagacatcttaagggtaattacagaaatttgaatatagaacacatatgtaataaaattcattttcttaggtatgattacaatattcttgttatacagaagaaaaaccttattcttgggagatgcatactaaaacattatggggtgaactgtcatcatgtatatggttttcagatgctcaacaaaagtgtgtgagaaaataaaactgtggcaaaatattagtaactggtaaatctaggtgaagcatatattatgaaattattatcgtatttacaggtatttattttactggtgcatctatctttctatgaatgtgagaattttcacaagagatgggaaaatgttcataattatgcatgcagaataagcccaagctggtggcattctgttcagttacaggtaattttctgaatcctccctcaaatttttctcaaacctctataatcaagggggaaaatgtttcgttttgttttgcttttttgagacagggttgcctataatggagtgcagtagcttgaccacagctcactgtagcttcaacctcccaggcacaagcgatcctcctgcctcagcctccaagtagctgggattacagatgcatgccaccacgcccgactttttttttttcctttttttgatagaaacagggtttcaccatgttgcccaggctggtctcaaactcctggactcaggcaattcaccggcctcagcctcccacagtgctggggttacaggagtgagccaccatgcccagttaaaaatacattttttatttaaaaaaaaaaaaaaagaacattccttatatttcctttatattttttaaactacatacccaaaataaagcatatcaaaaactgtattaaaaaaaaaaccctaatatcagatattccaaacacaacaataccataatttaatcacttaaaatcttactcaaaactaaatcaatgatcttttaggccaggtgtggtggctcatgacactaatcacagtactttgggaggctgaggcaggaggatcacttgaggtcaggagttcaagaccagcatggccaacacaatgaaaccccatctctactaaaaatacaaaaattagccaggctaatggcacactcctgtaataccagctactcgggaggctgaggcaggagaatcgcttgaacctgggaggcagaagttgcagtgagccgagatcatgccactgcactccaggctggacaacagagcaagactctgcatcaaaaaaaaaaaaaaggaatgatgttttaatatattcagatacacaaatgtgaaataaaactaagtagagctggtattcatttacacataattatcttataccatttggaataagaatttggggcacgttagcaaaccaaaaggctcagaaagaagttgtgatatttagttcttgtctccctctacaaatgtgaagcactcttctatccagcattcctagtggagttcctattttcaaatttgcaaatcattctggtcctaagcaatctcaaaaaaacatttctaaaaaccaaagaggaaaaaaatccttttttttttttttttttttttttttttgagacagagtctggctctgttgcccaggcaatggtgtgatctcggctcactgcaacctcggcctcccgggttcaagcgattctcctgcctcagcctcctgagtagctgggactacaggcacgtgccaccatgcctggctaatttttgtattgttagtagagacggggtttcaccatgttggccgggatggtttcgatcccttgacctcatgatgttcccacctcggcctcccaaagtgctaggattacaggcatataggccaccgcgcttggctgaggaaaaaaatcttaaaactaacttatttcaaatctaacttcaacgtgtatctttttttttcttttgagacagagtctcactctgttgcccaggctggagtgcagtggcgcgatctcgactcactgcaagctccgcctcccaggttcacggcattctcctgcctcagtctcccaattagttgagactacaggtgcccaccaccacgcccggctaattttttttgtatttttagtagatatggggtttcactatgttagccaggatggtctcgatctcctgacctcatgatccgcctgcctcggcctcccaaagtgctgggataacagacgtgagccaccgcacccggcgtgtaagccaatttcttagaagaaatctctccctctttctccacatatatgcatatatgtatgtagcactaatccttgaacagtgtatcctttactcaaactgagaaagaggaatttttaaaacatatttcctatcagtagataacccctattctatgtttcccttcttcaagctcccctccaaggacatgtgttaagggacaattttcttcccaagtacatcatgcatttttcccccttcattcttacctgcattacagatgaaaaggctttcttttctcctacagtctctagtgctttgtaggtggcacataagtagaggagtttaacttcatcttttgcagatgagctaaatttgctaaaaatccacttgaagatcttctcagcctcatagctcagagaagcacaaagaaggccaagacagcaagctccctcctgtctcaactcctgaagcaatttgctactgtgtttattttaatgcaaacaaaaaacacacacaaaaggcttaagttttctatgatgacacgagtaatacatcttacaaaagaatgtcttaagtggttttttaaatttctattcaaactacataaaaggttgaaattttctccactctaaatactacattctgtctagcctgcattgccctcaagtatctgtctgacattactttctttttacaaaatcaattatttacaaacagtgagggaaggcccaaaaatgctaaattccatctcaaactgtattaaataactctcagaaaagggcagcaacaaataattagataaaacactctatacataactacattctacataatatccaatatgtaatgactataaaataaaaaatggtaatagttaaatacagaaacttaaaaggataacagtaatgatttacatagaactttaataagtaactctataaaacaaaaccatcaaaaggcactaaggtttatgaccagctgagataaattttgggtacttgccaacactgcaaatctttgggaatcaccataacaaaaaatgaccacacacctctggagacgctaatagccagagaatatatggtttggatccactcttacccaaagaaggaaattcctttttacctctattctctaagcagtttcaaattctctagtttacaaaaactaattttattcttcatgcctgcatcaagagtttatgccattccataagtcaagactcagttatccagtgagactagtaaattaaaaaaataaaatattccagccaggcacggtggctcatgcctgtaatcccaacactttggaaggctaaggtgggtggatcacctgaggtcaggagttccagaccagcctggccaacatggtgaaaccctgtctctactaaaaatacaaaaattagctggcagttgtggtgcatgcctgtagtcccagctactcgggaggctgaggcaggagaatcacttgaacccgggaggtggaggttgcagtgagctgagatcgcaccactgcactccagcctgggcgacacggtgagactctggctcaaaaaataaatattcttttcaagtggattccatttgtattcaaccgtaattaacacataattaatgcagataaaaatgacaagacccactgaaatgtcaatagatgttcataaacaaagccagtgggtttgtcttcttgtgtattgttaagtaatttctaaaaatatattttaaagtcatttaaaccgaaccattattagttacttacctttcattaagcacatcatgtgcagcagccaagatattatccaattgtttaactagtacctttaaaagaaaacacatttataaaaacttcaaattcctatacttttaagaatagcattgtgtacttttttacttgtcttcccctccaaattctaattcaacagtactttactttctttattattcccactccccaatgagcatgtatcaggaatgtcatgtttcctttcagcctatgaaagaaattcacccactggaaacatagagctgtgatcatcaacaaaaaaataaactcaaaaagtttgttttatttactttgaaatccatttgaaaaattgactgatggatggagggatagatggagagatatgtgacaaggcagtatttagggcaaaacattaacgacaaaaattagatgatgggtttaacagattcaatgtcaaattctttcaacttgctatatatttgaaactactcataataaaatttggaaggaggagaaacttgctttgatccaagtgtcatctgcctcactagaccattttcattaattttctcctgctcattgtcaagttctttttttttttttttttttaagatggagtttcactcttttcgcccaggctggagtgcaatggcgtgatctcagctcactgcaacctccgtctcctgggttcaagcgattctcctgccacagcctcccatgtagctggaattacggtcatgtgccaccacgcccagctaattttgtatttttagtagagatggggcttcactatgttgggcaggctggtatcgaactcctgaactcaggtgatccgcccaccttggcctcccaaaatgctgggattacaggcatgagccaccacacctggcccatatcaagttcttaattggtgtaaagaaagtgaagaaaaaaatttaacccttcctatactttgttacatttctgttgttgttttaagagacaaggactccctctgtcgcccaggttgacatgcagaggtgtgatcatatctcactgcaaccctgaattcctgggctcaagtgattcttccacctcagccaggtgtagtggcacatgcctgaagtcccagctactcaggaggccacagcgggaggatagcttgaatccaggagtttgagactgcagtgagctatgattgtgccactgcactccagcctgggtgagagcaagatcttgtctttaagaagaaaaagaaattacatattagagagcattaagttcttgatcatcataatacagactttccccattcttaaactactcaaggtagcattacctagtttattatggaaacacaaaaatcctcatatttccaaacatactatacttaccagcttattttctggttgctgaataaattctttcaactgctttacagtgaccaatcttcagtctctgtcgtcttcccgggtgatcctccgaagaagatttgacagtcgagactcatcacaataagacatcgatctctctgtgaatatataaacattttgttgtccattgagtataaataagcaaaggaatttttaaattttaaaataatttttaaatttttaaaattaaaaattatttaaataataattaaattattatggtggctcatgcctgtaatcccagtactttggaaggcgggtagatcacatcagttcaggagtttgagaccagcctgggcaacatggtgaaaccctgtctccacagacacacaaaaaattacataaactagccagccaaggtggtgtgcacctgtagtcccagctactcgggaggctgaggcaggagaatcactggagcccatgaggtggaggttgcagtgagccgagatcaccccactgcactccagcctgggtgacagagcaagaccctctctcaaaaataaaattacatcaaaagtcacagtccactggtcaataaaagctcagggaatataggtcctatcgctcttttgttcaactctatattccaaatcccagcagagtgcctggcacataacagaccctcaaaaaaatatttgctgaaggaaacgagaaatgaataaccctaggccagctgaacacctcattccagaggactggctgggagagaaaaaagaaaggccttagtaacaacttcctttgggtccattccaaactgttttcaacatgcaggtaaagagcctgggtgtaggtaaattaaacaacttccaaggggtacggataaagcctcaatcgagtaaaaacaggatataggcttctacttatcatctaggtatcccactggaggaaagcctcttattcacattatcatcatttccctgggatgaagttttggggagccataatcacacatttagttcaacaaatgtctaattatcatctaccacatgcaaggcatgcctccactagaaaggtagcaaaccacaacttttctccccttattttttaatcacaagaacaagcacacaatagtgaatactattagtatattaacaatgcctttaaaaactagatttttgctgggcgaggtggctcttccctgtaattacccagcactttggaagggcaaggcaggcagatcacttgagcccaggagttcgagaccagcatcggcaacatggtacaaccccatctctacgaaaaatacaaaaattagctgggcacagtggcacatgcctgtaatcccagctactcaggaggctgaggtgggaggatcgctttagcctgggaagcaaaggttgcagtgaaatcacactagtgcattccagcctgcgtgacagagcgagactgtctcaaaaaacaaaacaaaacaaaaaactcaatttttgcaaaacattttcaactgtgctatttaccataattagccaatacatacgtaaacaacaaatcacaaagggtctgacagtttcatttctaaggtatgagaaaaaattgataataaaagaaaccagaaggctgggcgtggtggctcacacctgtaatcccagcactttgggaggccgaggagggcagatcacggggtcaggagattgagacctgcctggccaacatggtggaacttcgtctctactaaagatacaaaaaattagccgggcatggtggcacgctcctgtaatcccagctactcgggaggctgaggcaggagaatcactttaatctgggaggtggaggctgcagtgacctgagatcgcgccattgcactccagcctgggtgacagggagatactccatctcatagataaataaataaataactacaaggggagcaaaacacactggatccttttggagggtggggggtgggaggagggagaggatcaagagaaacaaccaatgggtaccaggcttaatacctgggtgataaaataatctatactacaaaccctcatgacacaagtttaccagtgtaacaaatctgcacttgtatcctgaatttaaaagttaaaaaaaaaaaaaaaaaaaaaaaagaaactacaatgtctgagagaagaataggatttttacaaatccgtagcccatagagtatttcaataaggacagataccaaaaatgtcatcaagttaccagctgggaaattaggctctacttacaattctgtcactagcaaactacctttgaagaagaggaattgtttactgaactactttagagtcactgtttagcttctataatatcataagtctaaggcttcaaacactctgttttaacaaacagcatacatagcctttgaattcattccacttgtgaaaacataaaaagaaatcagttttttaaaagttatataccaacaataaaagctacaggcacaaagattttcaccaagatacacgaagcacacacacagtataaaaaaaaaaaaaagtcaaaaactaaatgtccaaaaagtaattacatctgacaaagcccataactcagctttaccgataaatttctctttaaggaaaaaaattatcattacctctaatcctctgaactttcttttttgttgttgtttttttgagacggagtctcgctctgttgcccaggctggagtgcagtggtgcactcagctcactgcaagctctgcctcccgggtagctgggactacaggcgcccaccaccgcgcccagctaattttttgtattttcagtagagacagggtttcaccgtgttagccaggatggtctcgatctcctgacctcgtgatctgcccgtctcagcctcccaaagtgctgggattacaggcgtgagccactgcacccggccaatcctctgaacttccaaggcactcacctatacagtgaggctacgccataaggcagaaatgctatcagtgtatttaactttagaaaagtgcccactctaggcagggcccagtggctcacgcctgtaatgagcacatgtgatcacttaaggtcaggagttcgagaccagcctggccaacatggtgaaaccctgtctccactaaaaatgcaaaaatcagctgggtgtggtggcatgtacctgtactcccagctacttgggaggctgaggcacgagaatcacttgaacctgggaggcggaggttgcagtgaggagagattgcagcactgcgctccagcctgggtgacagagcaagactctgtctcaaaaaaatatattgaaaacaacaacaaaaaaaccagaaaagtacccactctagggggcggggggaaggagagcatcagcaagaatagcttaatggatgctgggtttaatacctagatgatgggatgatctgtgcagcaaactatcatggcacacgtttacctacataacaaacctgtacatcctgcacatgtaccctgaacttaaaagagaaaaaaaaaaaaaagacagaaaagtaccccctctatatatatatctatatcctccacaggcccaagagttcaaggacttgctgtagtaagagcctactatgcactatacattcaatatccacgataattgggtaaaccttttctgtaagatcttatccagtcttctaatcttgttttaagagaattctcttttaaaatgtactataacctttctagtgggaaattaacaattcacaggaaaagaatgtaaacaatttttacctgcacagtagactaatcaacttatgcctgtgcaaggcgttagtaagaggcatccagaataagaggagatacaagtctttggaaggtgtatgtgattggtccccattttcccagacttaccctgtgatttcctcatgtctttggtggctaaagcacgactgccatgctgaacactggtgaactcagggctggtcacattgttaaccctcagctcttgccccaacgacttccgaccataagtattttccccagatcctccattgacactgtagccacctacaaacagcaatgtgtacgttatttaaatatgattgttcgtttcattcagtcaatttcctgatagctcaggatcttactactcaatctgcagctcaaccagcctttgcttctcctacctttttcctgtactgtctgccttgaaaatcattttcatttcttttaatacacctttgaagttaaattaattttattttgatcccttcattggaaaataagcaaagaaatgaaaactaaattaaatcaaattttgcaccttaaaactttcttgaagtttagagacagtagccaagaggaacttcaaccttagctaaatatttttgaaaataaaaacaaaaatagtattgtatcttttttgtaagaaaactgcattgatgaattatgtacggaaaaattttaaattttaaaaataataaagtggataaacgtcctatgaagttttcagaaataacactgcatttgttattcgtattttaaatatattagaagaaagcgagaaagttgggggtgtaagaaggcaagaaggtgggataggtaggttcaaaaaacatgcttgtagcaataagaaaatatatatacccttttcgtcattctgtatgtcagcgtggactctggtatcatcgtgcctttgccgagacaccacagctgaatttgaaggttgcagtccgtaagaggaagaaccacctctatctctggatgaagaatattttaaattacctgggtcagctgatgcactatcagttctataaaaagagaaaagtttaagattagaactttaaataacataaataaatctttctttaaacaagcctctcttctcccaaattttacatttaaccattactattgtatttaatgtaatatgtactatatattatatgtaagcactcagccgtctaataagaagtctttcactgggaagagattctcaatggatgaaatgccaacttttcagtctcttctactgttctaaagacccattcagaaatacgaataactactgggattagggtgactttgctggttttagcattgaaagcctcctgtcccaggcaaaacaggacaattggttactctggtccagtgttctcctcacatgacttgataataagaataattctttctaaattctcccccatggagagggttaatcagtcaaaacatttcagcctttcctatcataaaaataaaaaacactggcagcatgtcagggacaggcaatgtcttaccaagttattttctaagtactgattaggtactgtagtattgaagaccccattgaagatgccttaattgtaaaggtagcaatcaaaattttaaaaagtaaaaaagaagacattttaagaaaataaaaggtatcagaaatgcaataacgttatatcggaaagttgtagttcataatctatttaaaatttaggtactgtttagaataatacctgatgcttattagtaaacaagtagggtacagccaagggtaaaagtttgtcctcatctaagtatctgctctacgcttcaactgcctcataagtaaaacagagctgagttacaagacttctcacgagtgttactctttcagccatcaatcataaactattaagaaagaagacaacaaaataatctgttatagcatatgaaaaatccaagtaagttcttcccctactgattttctcctgagaggaacaactttgaggaaaaaaaaaaagaaaatcacttctatgatatttactaaaaatgctttctcaaccttttagaacctgaatcttttagaaaagtttaggacactggcaaggccagaaactaacctattcctctacgctttgcccctctatggtgtaaaagtgacagcagtgtttgtatactgtatatatttcatttagagtttattagtctttccttgctcccaaaaatactaaacataaaactttgcatgagctcaatcagttggacaccttgatctgcacttactgcaatcactgttaatacagaatgcagacaataggtccaattaaacttggatatctaactggtacaagtcattacttacaaaggatctcaatctgaaacttcatgaaattcaaaacctagcatactaaaatgactacggctccataaggagtaccttctaatattcagagttcgcttattcataaagctaagtacttcgaacataagggaaaattaaatctatggaatttcaagaaaaatgtatgagaatattttctgagtatactaagtctataagcattaaaatattaactcaatggaccataacttttttaaactaatgaaaagacattccttatgtacctaaaaatagcacatttaacatgcgtctatataaatcatagcataccattactttctgaaaggagactgaaatgtaagagagcttataatcttttctgacagggtgtgaactttatatgtacgccacagtaagctcttattagatgagcaaataaaataagcacttgactaattcagaaacacaaagataactgaagtctgccaatatttaaacatatcttcacttcctgttttcatcatgtttacttatctcctatactacctttactattaagagttaaatgtttgtatcattttctggtgacacagtagtaccataaggcagcagagaatacaagttaaaaaaagatctgggctcaaatcccagctccagcactgaaaagtatgtgtgcctttgcacaaattacttgatctccaagccttggttgtctcttgcataaaatgaggatgatacctatctaacatgtaaggttgttgtgaggcttaaataagataatgaattataaagaaacacttagtttgcagggtatgttaaaagttattatgaccataatacaaaataaactcagtttccagtctaaaagacaatgtacaaacagttcatgagtatatgaatataatcaaaacaagtttttacagtcaatatagagcaacttaaatacttcactgaagaaagcaggtaatctgtggctaccaacaatgtgtttccaactaggaagcatctgatttcaaactaaactgtaaaaccaggagcagcttccccattggttagaaataaggtttctaaatcccctaagttatgaacactgagatttttttcccaaaaaaatttgtgttttcagaaatatagcaaaaaaactggaatagagccactgtctcagaaatacctgaaaactccctagctgccaaattattttaatacaaattgatcaaagcatccccaaccagaactcaggttgtaagcattctgaacctaaaagcacaaaatggtttagcatttatacgaaatttctatttttatacaatcttgactgcttaggtttcaaaaaatgtcaatgtcaggctgttagcaccaacaagatcatcccagtccaataaatagaaaactgttaaagaacgggaatgagaacttaaaatgaggcaatcaaagccacaaaatagaaactgcagatttgaactccaagaagcaggcatgaatgttaggctagttagttagaagagctgaaagggatatcatctgccagaattagtgtctcaatttagtgaaaaaagaaaatctatctgttaagtctaagaatcctaacaaggatccaaaaatacttctacagcccctttaatattctaaaaatatcatggagagaaaaaaaaagaaatgcataaatttccccaaaacgatcaaactaaagttaaagcctgaggtacatgccacatgagaggtaagtttctaaagctcatacctcaaaaatcgcatactgtgtaacatggagcctttgtgatgttttgcatcaagtcaatctgtaagacagtagttacaatattagtgaagacagtgggttaaaacatttgttgttcaaacatggagcaaatatcattcatgagttaggtgcctttagttgaactatggtcccattagggttcatacattaaagcaaaaattgaggtggaaagccactccgtgccttacaggataaagaggcttaatgtggcaaccaaaaaatttttagtacataagagaatttaaatgttaactataacatacaaatcacatgcaaatatagttaccacttattttagttacctcttctcaatatacagaaaaatgccacaaatctaggaggccactggtttcaaatgaccggaatccttagacctcacaccaacaatccaccatgtggtggggatggtatcgcctgactaaatgtagtcttgcagtccattcttgtaagtattagagagaaaaagagagagagcgtcatctctgcaaagtgtgaagtcagggacttccctactaggaagcatttccataaagcaccccaaaatgacttgatgcaaacaccacacctagtggtgtcactggagtaagcatcatattacttcaaattgcttttacctaggtttattaagggattttgctctcatgctgagatctaatttgtaatggatataaaccaggaaatgagatttgcactaaagccaatgaagtaggaatgtacttattctctaaagtagcaaagatagtctcactgtcacagagcagttataggatatgttgctttccatactaatggttaataccacttggaaatgatttacccttcaaaaataaattcaaggttttcccctgtaatgcctcttacctggattcaaacatgctttaatgaggaataagagaaagggtgaaactatgaataaccccgggccttgtatcattacattagaaacactgctctaaatatgagtctatggctaaaatattaatttgagaggctcagggaatttattatacaaatctcttcttgcagagaactttaagttcaaatttaataaaacaaaacagaaccattccacgtcaaaattgtaaatgagtatgcatcagttttgcaatactgagatactaaattaatataatttattggtaaaactagtttaactacctcagtattaagtgtctataataaccaaatcttaattatccatttatgggtgatttgtttccttttttgagacagggtctcactctgtcacccaggctggagtgcactggcatgaccatagctcactgcagcctcgacttcatgggttcagcctctcaaacagctgggaccacaggtgcatgccactccatttagctaattttttatttttatgttttttggagacaggtgtctgattatgttgctcaggctgctctcaaattcctggactcaagcaatcctcctacctcagcctcccaaaatgctaggattagaggcatgagtgaccacatctggactgtcaccaatttttaactgtctctcaactaaacagccaatatagactgataaaatatacttaactattgtaaaattgtaaagaattgtatcttcaccaaggagaggtctggcttttacctgtgaattctggaaggtaatctctaaactcttgaaatgtcatacctaataagagggtcctggccaggagcagtggctcacacctgtaatcccagcactttgggaggccaaggcgggcagatcgcttgaggtcaggattttgagaccagcctggccagcatggtgaaacctgtctctactaaaaatacaaaaattagccaggcatggtgacgggcacctgtaataatcccagctactcaggaggctgaggtttcagtgagctgagatcatgccactgtactccagcctaggcaacagagcaagactatctccaaaaaaaaaagggggggggggcggcggtggggggaaagtgtccttgttcatctgggggctttaggccacagcagagtctaataatgtggcttatggtgggggctttgagtcacatggatcagcttgacctccagtggggctggagactaaggttagccacatgggcatgcaaccatggaaccccagtaaaaacgttggacataaaaaatagagtgagcttccctggttggcaataatccatgagtatggtcgcacaccagtgccaccaggaaggtgtcatttttcacaactctacagggacaggacaattcaaaactccaacatttggaacttccccgaactctgccctatgcacctctacccttggctcattctaatctgaatccctaaactgcaataaactctaactatgggtatgagagctttcaatgagttctggtgagtcctcctggcaaatcatccaacctaagagtggtcttggccaggcacagtgactcaagcctgtaatcccagcacttcgggaggcccaggcaggcggattacttgagctcaggagtttgagaccagcctggcaatatggtgaaactgtctctaaaaaatatagaaaaactagccaggcgaggtggtgtgtgcccatagatccagcaactcaggtggttgaggtaggaggactgcctgaacctgggagggaggaggtcagggcacagtgagccgtgatcatgccactgcactctcgcctgggtgacagagagaggccctgtctcaaaaaaaaaaaaaaagagtggtcttgggaacccccaaacttgcaactagtattagaagcaagggtcatcttatggactggactccctcttactctgcactcatatttaaaaccattaaatatactgtagctcaaaaaaaattgctcctttgttttgaaaaagggtctcacactgtcgcccaggctagagtgcagtggcgcaatccgagctcaagcaaacctcccacatcagcctcccaagtagctgagaccacaggcttaccccaccacgcccagcaacttttgtatttttttgtcccattctctacaacattcccaaaatgttgcccaagctggtctcgcactcctgagctcaagtgatccactcacctcagcctcccaaagggttgggattacaggcataagccactgcacccggccataaattttgttttttagtaacatttctagcaaacatgataaagatttgacttcagtgttgcttattttccttccaaggaacctctaatattctctattttcagaactccaatcaaattagccagaaagagcaaacgaagccaataaatctaggagggcaatagatctgattttaacccttgtttcacatgcacaattgtcttcagagaaaagctgaagaaagtaccccctcacctccatgccccaatgctccttttctctgacttcaagtgggcctctgatgctgcccacatttccctcaccaggtttctttcctttccaaaacatctgtaaaactttctgcaccttcttccttctcccaccactaccagtggatgaccttatagatttctgctccatgagaaatagaagccatttgacagcaccctcagcaagagctaacattttagctcctaacaagagctagtgggcaactgatccaagcagtttacaaatgtttatcatgtcatttcgtgttcaacacaatcctattagttataacttgataactaaggtttcataactggcctaaggttgcacagcttgtaaaaggcagagtcagaactcagacccagtactgtctaatgtttgagctcttcaacactccatcgctgcctgtcatcttccttctaatatatccacaaattcacctgcatctgcacatacaccttttcttcccatcatcttcccataatggaacaaataaacctcctatccatagaaatcatctggatctgtctattccccccattttccaaggtatgtcttgtcttttttttttgagatgtagtctcgctctgtcgaccaggctgaagtgcagtggcgtgatctcgactcactgcctcccggattcacgccattctcctgcctcagcctcccgagtagctgggactacaggcgcccaccaccacgcctggctaattttttgtatttttagtagagacggggtttcaccatgttagccaggatggtctcgatctcctgacctcgtgatctgcccaccttggcctccccaaagtgctgggattacaggcttgagccactgcacctggcctgtttcttttgtacgttgcaaaatctcccattttactactgcttatcacatcgtcaacatatgagcactctcaaaagtcttactttaaaaaaaacaaaaacaaaaacaaaaacaaaaaatggccgggcacggtggctcacgcctgtaatcccagcactttgggaggcaaagacaggcagatcataaggtcaggagattgagaccaccctggccaacatggtgaaaccccatctctactaaaatagaaaaaataaaactacctgcgcatggtggcacgcacctgtagtcccagctacttgggaggctgaggcaaaggaatcatttgaacccgggaggcagagcttgcagtgagccgagatcgtgccactacactccagcctggtgacagagcaagactctgtctcaaaaaaaaactaaaggccgggtgcagtggctcacgctggtaatcccagcactttgggaggtcaaggtgggaggatcatgaggtcaggagttcaagaccagcctggccaatgtagtgaaaccccgtctctactaaaaatacaaatatcagccaggtgtggtggcgagcgcctgcaatcccagctactcaggaggctgaggcaggagaatcgctcgaatccgggaggcagaggttgcagtgagccgagattgcaccatttcactccagcctgggcggcagagagactccatctcaaaaataataataataataaaataaatttaaaaattaagaaaataaggccgggcacggtggctcacgcctgtaatcccagcactttgggagggcgaggcaggcagatcatgaggtcaggagtttgagaccagcctgggcaacatagtgaaaccccgtctctactaaaaatacaaaaaattagccgggtgtggtggtgggcgcctgtaatcccagctagttgggaggctgaggcaggagaactacttgaaccccggaggcggaggttgcagtgagccgaggtcgcgccattgcactccagaccgggcaacagtgtgagactctgactcaaaaaaaaacaaaaaacaaaaaaaccctttaactgcctttctccctctatcaatctaatagcctggactcttcacagacaaacctgttgaaaaatttatcttccttgccttcatttactttttaacccactttaatctgggttccacctgcaacacaccactgaagctattcctactaagataggaactgccactcaaggccttcttggctctaaaagcccatgagcctttatcagttcaccttacaatttctcaataccattctaaagtttatgagttttttaactttaattccagtgactctttctactttatcccaatccaagtattctcctccttctttactttttttttttttttttttgagacagactctgactttgttgcccaggctggagtatagtggtgcaatactggctcactgcaacctccacctccaggttcaagcgattctcctgcctcagcctcccaagtagctgagattacaggcccctgctaccacacccggctaatttttgtatttttagtagagacagggtttcgccatgttggccaggctggtctcgaactcctgacctcaagggatccacccgcctcggcctcccaaagtgctggaattacaggcgtgagccaacgtgcccggccccttcttcacttctttaaccagcttagatttcattgtgtatcatttcaacaacactcttgcctatacccttaactcttaagattttcatcacagccatctggcaaaaccccaatcctggataaacccaacgatccatcaataagcaccacactcccaggtcctccagtgtttacttcccattctatacatgcactatccagacattcccattctcttcaaattccaaaatatcctatccacctgccctccccatacacacattctacttcaccaacaacaaaaaaaaaggtaccagctgggcacggtggctcacacctgtaatccctgcactttgggaggccaaggcaggtggatcacttgatgtcaggagttgggacaccagcctggccaaaatggtgaaacctcatctctactaaaaatacaaaaattagctgggtgtggtgatgcgcacctgtaatctcagctacacgggagactgaggcaggagaatcgcttgaacccaggaggtggaggctgcagcgagccaagactgcaccactgcactccagagcctgggcaataataagagcgaaactccgtctcggggtagggtggggaagataccataaaatatctgcacccgattctagaccttactgaggattccatctacttccaccttactgtaactttgcaaatacttttcccactgaactaaatcccccccataaacaagcaacactttctaatgtatcccattgaaaaatacaaaaacatataaaaaggaaaaactccatcaatcccacatgtccctccatcaaacaatctgccttacttgctgcagccaaactaaagttgtctagactcccctctcccatttcttcagttcttctagctccttaacacacactggtccaatttctgccccatcactcttggcaaaatccattatgacctccaggctgctaaatccaagatacagttcaggcctcaatctgctcatcctttcagcagctttcacagggctgctgagtagggttgagcagttttgccctgcacacaggtgccctgcagaggaatgaggtgggctgaatgaaactccttttttaaaaattctcggctggcatagtggctcacgcctgtaatcccagcactttgggaggctgaggcagacggatcacttgaggtcaggagttcaagatcagcctggccaatatggcgaaaccccatatattaaaaatacaaaaattagctgggcgtggtggcgggcacctgtaatcccagctactcaggaggctgaggcaggagaatcacttgaacccaggaggcggaggttgcagtgagccgagactgcgccactgcactccagcctgggcaacaagagagaaactccatctcaaaaaaaaaaaattgtttatgccaactaattgtacacctaaatgcaccaagttcatgactttctccttgcatttatttatttatttattttttaattaggtctcactctatgttgcccacgttgtagtgcagtgtgtgattacagctcactgcagccttgaactcctgggctcaagagatcctctggtcttagcctccccagtagctagaactataggtatggagtggctctctgcctttatttctaacccaagctaccttacaaccttaaaaagagacgctgcttcgccaggcacagtggctctcgcctgtaatcccagcactttgggaggccaaggcgggcggatcatgaggtcaggagttcgagaccagcctgaccaacatggtgaaaccctgcctctactaaaaatacacaaaaacttagccaggcctggtggtgtggcgcctgtagtcccagctactcaggaggctgaggcaggagaatcatttgaacctgggagacagaggttgtagtgagccggaggttgtagtgagccgagatcacgccgctgcattcccacctgggcgacagaacgagactcaaaaaaaaaaaaaaaaaaaaaagagagagaccctacttcagctctcaattgcatcgcttatcttccccttttgtcagttaagtcctggaagtaccctagaaacctatcatttggcctgggaaattgccaagattgaaaggaaatgtcttactctatgacctctttaacagatgaaggacaaaaaaggctgaaaatgtacaaagatatgcatccctcccccaccagttaaatgccaaacataggccagccacagctgatcacacctgtaatcccagctgtttgggagtccgaggcaggcagattacctgagttcaggagttcgagatcagcctggccaacatggtgaaacccagtctctactaaaaatacaaaaaaattaggcaggcgtggtggtgcacatctataatcccagctactcgggaggctgaggcaggagaatcgcttacccagaggtggaggttgcagtgagccgacagctcgccactgcactctggcctggagaacagagtgagactcagtctccaaaaaaaaaaaaaaggccaaacatagcccattccaaccaagattaagaatcactaagagttacattgcaccactgcacaccagcctaggtgacagagcgagactccgtctcaaaaaaaaaaaaaaagagttagttacacactgcagaaatctaaacaatctcaaaagtagactgggactttataatcaaggtaaaggtgaagtgatgtttaccaatataagaaatgaataggccaggcgcggtggctcacgcctgtaatcccagcactttgggaggccgaggcaggaggatcacaaggtcaggagatcaagaccaccctggctaacacagtgaaaccccgtctctactaaaactacaaaaaaattagccgggcgtggtggcaggcgcctgaagtcccagctactcgggaggctgaggcaggagaatggcatgagcgcgggaggtggagcatgcagtgagctgagattgcgccactgcactccaacctgggtgacacagcgagaccccgcctcaaaaaaaaaaaaaaaaaagaaatgtatgcaaccatttttttcaactcctgaaaatagtcagataataactgtagttattctgataaagttcctttagccaacaggttgaagcacattcccagggaataacatgtttataagattttctaacaattgcatatgttaaatcttctctttaaaaataatcctggccaggtgcggtggctcatacctgtaatcccagcactttaggaggccgaggcaggtggatcacttgaggtcaagagttcaagatcagccagaccaacatggagaaaccctgtctctactaaaactacaaaattagccaggtgtggtggtgcatgcctgtaatcccagctactcgggaggctgaggcaggagaatcacttgaacctgggaggcggaggttgtggtgagccgagatggcgccattgcactccagcctgggcaacaagagcaaaacttcatctaaaaaacaggaaaaaataaaataaaataaataaaaataaaaataatcctaggccaagctggctacagtagctcacacctgtaatcccagctactcaggaggctgaaacaggaggatcacttgagcccaggagtttgagaccagcctgggcaacacagtcagactgtgtctctaaagaaaaaaatcgtcatcatcctaggccagtccagacaacatagcaagacctccaactctaaaagaaaatgaaataaaaaattttaaaagtcaatttaattagaggtctcaagtaattccagaagatacagtctcacaaatcaaatactgagaaaggaagacacctttcaagataatcacactattattttaactgtaggaaaatgtattaaatgaagacagcttttgctagctgctgaaacatactagtaagaacaggaaacgatgctcccaccatgctcagcagtagccagaaatttactgaggtctttgtatttagccttaagtataagacacctaggaaacttcaaaatcatcacttaagccactttaaacccacagtctatacaaaccctttttcttttgttacattttatactaaacacactttaatcagactgacataagtgatttaaaagtaacttttataattcccttttacaagaaaaaaagaaacaatgtttccagatactaagttccttaagagacagcaatcatttattatagatttacagtactacaatttcaaatagtaccagaatctttttttttttttctttgagacagtggcacaatcacagctcacggtagcctcgacctcctgggctaaagcaatcctcccacctcagcctcccaagtaggtgggactagaaactcatgacaccatgtccagcttttttttttttttttttgagacagagtcttgctctgtcacccaggctggagtgcagtggtgtgatcttggctcactgcaacctctgcctccagggttcaagcaattctcctgcctcagcctcccaaatagctgggattacaggcatgcaccaccatgcccagctaatttttatatttttagtagagatggagtttcaccaggttggtcaggctggtctcgaattcctgatctcggtgatctgacagcctcggcctcccaaagtgctgggattacaggtgtaagccaccatgcccagccaatttttttattttttgtagaaacgaggtctcactatgttacccaggctggtctccaactcctgggctcaggtgatccacccacctccctgccttggtctcccaaagcaccaccatgcctggcccaaaatcttgtaattgcttaatactgtatatacattcttataatgatatgatatttcccatatttgtgtagaagatgcatgtggttcttctccaccccctcaagtacttaaaactatcacattggcagagtacaacctttaaatgtttctggcatcctccctcctcccattaaaaaaaaaattaaaataaaaatatgtatatacacgcccatacacactacaacagagggaaaaaagcaactcattgttcaactggtgttcttataagaatcagttcttaaattccaactgtgtagtaaaaggtaagcaagctataagctaccttttaacctatcctttctctatatacgttccatttacattgtacttgccctccaatctatgcaaacagtcacaaagattagattatgtttgctggcttatcatttcaactagtaacaaattcttaaggtgtgaatacaagatatggagaaaaaatgatgatgcacagctatgctgaaatttcgtattgttcaacttgaaatacgtttacagcctaatgggagtacactagaaaatgtagaaagagagcaggcacggtggctcacacctgtaatcccagcactttgggagacagaggtgaatggatcacaaggtcaggagttcaagaccagcctggccaacaaggtgaaaccccgcctctactaaaaatacaaaaaaaaaaaattacctgggtgtggtggcacatgcctgtaatcccatctactcaggaggctgaggcaggataatccaggtggcggaggttgcagtgagctgagatcgcaccattgcactccagcctgggggacagagcgagactccgtctcaaaaaaaaaaaaaaagaaaagaaaaaaaagaaaatgtagaaagagagccactccactgcagagcaattaattctatctccactaatatttttctaaatattcactgaaacagttttaaaaataatttcctgaactttaaccctcccaacatcttcaaaaggcaaaaattaccccctcagagggacacagctggtagtgccaatacaaaagatctttgtcttcccattcttagtccatagcttttttcatgacaccagcctctcttaagataaatatctgtgaaggatcaactttttaaaatacacacattctagctgggcacggtggctcacatctgtaatcccagaactttgggaggctgaggcggaggtatcacctgaggtcaggagtttgagaccagcctggccaacacggtgaaacccgtctctactaaaaatacaaaaattagccaggcatagtggcatgcacctgtaatcccagctacatgggaggctgaggcaggagaatcgcctgaacccgggaggtggagattgcagtgagccaagatggtgccaactgcactccaggctgggcaacagagcaagatgccgtctcaaaaaaaaaaaatatatatattcttaaaaataaagacacttagagaggaatctaaaacacactggttctatttttaacttcaccaatgctaagacagcgggtgtttttttttttttttttttgaaaaagaaaagggaacaaatttcacataggagaatagtttttgaaatctttgcacaacagggtggccatagtaaataatgattatttatttgcaaagagaagacagagataacaatagcaataataataatgtatttcaaacaattaagagtaaatttcaaatgcctcaccacaaaatataagtaagcaaagtaaggcgatagtatgttaattagtatgatttaatcatactacattacacacatatatataaacattacgttgtaccctatgtgtacaattatgatttctgaattaatattagagtggggagaacaataatgattaatttttacttcttcagtaagattacaatgaaaatgtagagagcactagcattatagtaactatacgataggccactttaaataaatggcatcttttacaaaatttttagtcaataagttgattacgacatacttacgaactatttgctattaagtgtaagttaatttataattttagtattttcaaaaaaggaacatattaaaatcctatcaatatttcaaataatgacaaaattaatcatttttaatagaatccttactcaggtcctccaaaaacaatataaactatgacttaaggtaaattcctttaaatctgactaatgaataaatgttaaatctcaaatttcatagtcccagtgctggaaaatctatatttttatttttcttcacgtttatacaaagaatgtacagacaggcaagaaatgtaatcaacctttttaggaaagaatcccaggatttgttttcttttcaattaaatatatatgaattctgggggatactggtgatcatctctggatctttttactcatctaatgagaaaagagtctcattatacaaagaggatagtcaaaaagcctaatgatttcctcacataagtaggtttttctgtctggcaaatctgaagaagtcaacatagaatctgtcattaatgcattgaatctgaacttccactattcaaatcaaattaggacctggaaataaagtgttaacacttcagacaagaaattccagggtttgtatcatcaggaatataaaccagggacactctcaagaggctgaagagcaagagtcatgcactgcttcagagaattaaatactccaagatgaaagttaaaatttcaaacacacatatcacacatacacatcttttaacatcaggttgaaatgctaaagggaacagagtaaaggtatgtttttaattaataaatttaaatgagagaaaactttaaattcaaagagcttcagtaaaaaaaaaaaagaaaatattagcaatgttatcaaatgtggacgaaaagctaatatatgtcactatgtaatccaagacatattcattagtggcgccttttttctgggctattaatatattagatgccatccaaaaacaaatatctagtaaatattaagtttaacgacttcttaaaaacctgtaggttcccaaagacatatacatgtatgtgcagtgaggccactgctaagcctctaataatattcttgtagactactaaagttctctatgatgataaaaagggtaataaaaaaaaaatctagtgtctccccttaataaacaaagaacgagcataacttaggaagttcggtaacaaaaacaatctataattctggtaccagaaatccctctgaggctgggcgaggtggcttacacctgtaatcccagcactttgggaagccaaggcaggggggatcacctgaggtccgaagatgaagaacatcctggctaacagggtgaaaccctgtctctactaaaaatacaaaaaattagccaggcgagtggcacatgcctgtaatcccacctacttaggaggctgaggcaggagaatcacttgaacccaggaggtagaggttgcgtgagcctagatcgtgcccttgcactccagcctgggcaaaaagagcaaaactccatctcaaaaaaaaaaaaaaagcaacaagtccctctgaaaaaagttttaaataataaacaaaagtctataacaggtttttaaataactataaagtcctacacatattacatgaataccaacataataatatgaatatgaatatcaacagggtatccaattccttttttgaaaaggtctgaaaattaatatgaaagaagtaattctgtatgttcagaaatctgttgattctaggccaggtatgatggctcacacctgtgttatcccagcactttgggatttacaaaatgggatttcctcctcacctaaggtcaggagttcaagaccagcctggccaagatggtgaaaccccatctctactaaaaactacaaaaattagccaggcgtggtggcagtcgcctgtaatcccagctactcaggaggctgaggtaggagaatcacttgaacccgggcggcagagtttgcagtgagccaagatctcaccactgcactccagcctgggtgacaaataaaataaaataaagaaatctgttgattctggaatatttgcgtttcattccccaatcagcaggtatccaattggcaagaagtgtgtttccccaggcattctaatgggatgccagaaggctcaacccagtgcttaaatttttagtgattacattgcttaaataatgtagacagatacaatagattcaagataaatcaatatgtaaaaagactttaaatatgtgcacaaggtatttttcaagatggataaaacatatgaatcttaaattaccatctttttttttttttccctgagacggaggtttttttcctcttgttgcccaggatggagtgcaacaacagcatcatctccactcactgcaacctctgcctcccaagttcaagcaattctcctgcctcagcctcctgaatagctgggactacaggcgtgtgccaccatgcccagctaatttttgtatattttttagtcgagatggggtttcaccatgttggccaggatggtcttgatcccttgacctcatgagccgcccacctcggcctcccaaagtgctgagattacaggtatgagccactgcgcgtggccaaattaccgtattctttcttctgtaaaaagatctggccactccagtccattacgatactgtccttttgagcctgctcaatcagtttgtttaagccctgcctcaggctaacagggctgccataagaggaatgctttccccaaaaacacatcctacaagaacagtgttgtaatctctagagttaacacttaatataaaaacacaaacttgcaggatctcgttttcatgaatttacttgaggaaagacacaaatatagagtggatgctatttattgatgcacttagtaggaaagaaggggatagcaaaagtaacaattttaccagatccatgcacatatgcagattgtattttactagagatggcacacataaaaattccagatagtggtaaggatatgaaaaaaagtggcaggaatgggtgtgatagtgaaaaagtcactgcatatctgtaccttgactgaggtcatggttacacaggtgtatacatttgtcaaaatttactgaatttaagacctatacaggccgggcgtggtggctcacgcctgtaatcccagcactttgggaggctgaggcggatgggtcacctgaggtcaggagttccagaccagcctggccaacatggtgaaaccccatctctactaaaagtacaaaaactagccaggcgtggtggcaggcatctgtaatcacagctactcagggggctgaggcaggagaatctcttgaacccgggaggcggaggttgcggtgagccatgatcgcaccattgcactccagcctgggagataagagcgagacttcacctcaaaagaaaaaaagaaaaaaaaaaaaaccaccaccacctatacatacataaattttatctcaaagaagcaccacaatagaattcaaaaacgaaatcaatttaaaaaggaaaagtacactcgattaatacaagatggaaaagaataacattataaaaccaagtatctctgcatgagcgaactccacaagaatttagtaagttatactctacattaaaaaaaaaacaaaaaacaaaaatacagaataaggaagcatttcctatacatatgaaaccacaaaatttctgtaatctttactgttaggcctctatacaaggggaagtatgtttcattttatagttccaaaaataaaatgggctctgaaaaacttcaagatagtcaaagacaggtaaccaaaatgatgacaatgtgaaaagattaacaaacagctcctctaaatcattaagggtggtccaatgaaaggagcctcagggatttgttttaggtgattaggataaggaacaagagccagataacaaaggcagaaaatcctaaagaatttaacaattcaatgttcccaaaagacaccatggaccacactccattttatatgacacttaaatgacattccatacatgtgtctaacatgaagattgagcagataaaaagtatcactttagtaatcatcctcaatcaacaccagataacaaatgaggggcttttgcttatggaaattctcacatattgagctgaacacttttaccttaattaattaattaatttatttattttttgagacagagtttcgctcctgctgcccaggctggagtgcaatggctcgatctcggctcaccacaacctccgtctcccggattcaagtgattctcctgcctcagcctcccaagtagctgggattacaggcatatgccaccacgcccggctaatttttgtatttttagtagacacggggtttctccacgttggtcaggctggtctctcccgacctcaggtgatccacccaccttggcctcccaaagtgctgggattacaggtgtgagccaccatacacagccttatcttaatttaaattgttaaatataaacataatactcaggtccttagcagccccttctctatattgttccaattaactgcctcccactgcgatctctcttgcacgtgtgtgcacgcactctaacacacacactttttttttttttagacggagtcttgctcttgttgcccaggctggagtgcaacggtgcaatctcagctcaccacaacctcggcctcctaggttccagcaattctcctgcctcagcctcccgagtagctgggaatacaggcatgcaccaccacactcggctaattttgtatttttagtagagacggggtttctccatgttggtcaggctagtctcgaactcccgacctcaggagatccacccacctcagcctcccaaactgctgggattacaggcatgagccaccatggccagcccacacactttttcaagaagcaactagatttaatcttcctaaattgtgccactttccggcaggtaaaatttcaatgattccctaaagtcactccaaatacacttaaactgggccagggtggtggctcacgcctgtaatcccagcactttgggaggccgagatgggtggatcacctgaggtcatgagttcaagacaagcctgaccaacatggtgaaaccccgtctctagtaaatacaaaaaattagccaggtgtggtggtgcgtgcctgtaatccctagagctacttgggaggctgaggaaggagaactgcttgaacccgggaggcggaggttgcagtgagccaaaatggcaccattgtgctccagcctgggcaacaagagcaaaaactctgtctccaaaaacaaacaaacaaacaaacaaaaaaacacctgaactatgattaaaggtctacaatagggttcccaacccagtgcttcagcttcacctcttatttatattactcctcataagtacccaattcctctacacactgacaatttgcacctggccttatcctaattttcttctattttgggggggattctcccccaaattcacagtgaaaactgtacagaccaattccatcaccccattttccctcctctgaccctccaagtttttgtttttgtttttgagacagtctcgctctgtcacccaaattggagtgcaatggcatgatcttggctcactgcaacctccacctcctgggttcaagcgattctcctgcctcagcctcccaagtagctgggattacaggcacccaccactgcatccagctaatttttgtatttttagtagagatggggtttcaccatgttggcctgtaaccccagcactttgggaggtcaaggcgggcagatcacctgaggttaggagtttaagaccagcctggccaacctggcgaaaccctgtcaatcatgccactgcactccagcctaagtgacagagcaagactgtctcaaaaaaaaaagaaaggaaggaaggaaggaaggtatactgagaattacatcacaaaatccacatgctctccccttcacaaagccctttacttttctcccataataacttatagcctccttgaagacagtggttttacaagtcataaaaatcctggccgtggcccagtgcagtagcttgtgcctgtaatcccagcactttgggaggccaagacaggcagatcacttgaggtcagaagttcgagaccagcctggtcgacatggcgaaaccccgtctctactaaaaatacaaaaattacccaggagtagtggcacatgcctgtaatcccagctacttgggaggctgaggcaggagaatcgcttgaacccaggaggccgaggttgcagtaagccaagattgcaccagtgcatttcagcctgggcaatacagtgagaccccatctcaaaaaaaaaaaaaaattatggccgggcacggtggctcacgcctgtaatcccagcactttgggaggccgaggcgggcggatcacaaggtcaggagatcgagaccatcctggctaacacggtgaaaccccatctctactaaaaatacaaaaaattagccaggcgtggtggcgggcacctgcaatcccagctactcgggaggctgaggcaggagaatggagtgaacccaggaggtggagctggcagtgagccgagattgcaccactgcactctagcctgggcaacagagcaacactccatcttaaaaaaaaaaaaaaaaaaaatttatacacacacacacacacacacacacatctccctagaagcatcaatatttactgaattagagtattttattacctgttataaaaaacaaacaaaaaaaccttccattatactaatttataaaggaataaaaacaaaatgggttggggagtccaggcacggtgtctcactcctgtaatcccagcactttgagaagcacaaggtgggaacttgaggtcaggagttcgagaccagcctggccaacatggcgaaacccggtctctaataaaaaattagccaggcctggtgacatgcacctgtagtcccagctactcgggaggcagaggcacgtgaatcacttgaacccaggaggtggaggttgtactgagccaagatcgtgccactgcactccagcctgggagacagagtgaaactatgtctttaaaaaaaaggcggggtgcagtggcacacacctgtaatcccagcactttgggaggccgaggcaggtggatcacctaaggtcaggagttcatgaccagcctaacatggtgaaaccccgtctctactaaatataaaaaaattagccgggtgtggtggcacatgcctgtaatctgatctacttgggaggctgagacaggaaaacagcttgtacctgggaggcggaggatgcagtgagccaagattgcaccattgcgctccagcctggacaacaagagcaaaactccgtctcaaaaaaaaaaaaaaaaaaagttggggtgaggggaaggttcaacttaaagatacgattactaactgtttcataaggaatgacttatttcatactggagtaggagtttgacaccagcatgggcaacatggggaggccccatctctacaaaaaaataaaaataaaaaattagcgtgccaagcatggtgggtcacacctgtaatccttgcactttgggaggccaaggaggaaggatcacttgagcctaggtattcaagaccagtccaggcagcatggcaaaaccccgtctctacagaaaacaacaaaaaaaaagtagctgggggtggtgacatgcacctgtggtcccagctattgggagggtgaggtaggaggacttattgagcctggaagatggaggctgcagtgagctgagatggttccactgcactccaacctgggcactggagtgagactctgtttcagaaaaagagagaggaggccaggcatggtggttcatgcctggaatcccagcactttgggaggccaaagcgggtggatcacctgaggtcagcagttcaagaccagcctggccaacatggtgaaatcccatctccactaaaaacagaaaaattagccgggcatagtggcatgcacctgtattcccagctacttggaaggctgagacaggagaatcacttgaaccaggaggtggaggttgcaagtgagctgagattgtgccactatactccagcctgggcaacaaagtaaaactctgtctcaaaaaaaaaaaaaaaaaagagagagagagagagaggaaaaataaataaattagtcaggtgtggtggtatgcacctgtggtcccagctactcaggaggctaaggcgggaggattcccagagcccaggaagtcaaggctgcagtgagcagtgattgcaccactgcactccagcctgggcaacagagcaagagcatatctcaaaaaagaggaaagaaaagaaaagaaaaacataaaaacaaacgttcctttagttttaatttttattttttagtttattatggccgttttactctcccccaagtaaaacagccatgcacaatttgctgaaattttccttagtgtactttgaaatctgtggaacagaactggcaatcgctaaattctatttgactctagttccatttaatattagactggtgtgaaagtaactgcggtttttgccaaaaccgcaattacttttgcacccacctaataagtataaaatatgtaacttcacttaattttatcctttatgtatttccctatattatgtacctatggacatcaaacttagtacagactgataaaaggctgaacagacaactctggtttcaaaaatccagcttctcacaacatcagacatactagtatacagcttttctaatttcacaacacatttccattttttggtctttcacaatagagaagatgtgtatacttttgaatactctgatctgtctacaatctaccaaaattggaaggtgtttttattatacagtttcatccttttagaaatatacaaagatcctaagtttgggcacagtaagacactcaatatagatctactactaaacaagtaagaccaagtacataattaatgtcctaacacccccagtggagaagtaaaatctacttgttttctgttgacttgaatgccttctcttctttgttgaattaatcaatctacttgactccaatgtcaaattaatcaatgtcactttagaatattaaaatgtacaattatgaattacacatttaaaacacatcattctgatctctgtcttgattgatactagaagattatcttccaaactaaggtggaaaaaatgacagactttagctattggcaatgataggtcatttttttagggaagaggagtaaagagggcaacctccataggtcagatatccctttgttctaagaagccaccacctctgtttcttcatatgaaaaaaaccagaggcatccagtggttcccaaaaccttctcaactttacgcttgaggaacccacagatttcaaataatacaactgacctaagaccactcatttgtttaaccattctttttttaattttttatttttttttttgagaaggagtcttgctctgttgcccaggctggagtgcagtggtgtgatgtcgctcactacaacctccgcctctcaggttcaagtgattctcctgcctcagcctcccgagtaactgggattacaggcatgcaccaccacatcctgctaatttatttatttttttttttttttggagagacgggggtttcaccatgtcggttggctaggctggtctcgaactcctgacctcaggtgatccaccaacctcagcctcccaaagtgctgggattacaggcgtgagccactgcccccagcctgcttaaccattcttaaatgtcgggtgcggtggctcacacctataatctcaacactttgggaggctgaaggtgggcagattgcttgagttcaggggttcaagaccagcctgggcaacgtggtgaaaaccccatctctataaaaaatacaaaaatgagccgggctgttggcaagcgcctgtagccccagctacttgtggatgctgaggcaggaggcttgagcctgggaggtcgagactgcagtaagccaagtatctgtgccgctgcactccagcctgggtgaccacagcaagaccctgtctcaaaaaaattgacagaagagttgactgagagcacagtgaatgaaaaggaagactataagccagtgccatataaatgcttactgttggaggtatgcttctatggaacacgggtttgctctcttgccatatgacattcacgtattcagccacctggaacacttcctgtctgtatgtgtgaagtatcatgtgtggtcaaaattgactcaacagtcattttccacaccaactggcaaactaacactaaaagaaatcaacaagtattgctttttcaaaagcctaaatcggctgagtgcggtgacttacacctgtaatcccagcactttgggaggccaaagcaggcggatcacctgagtcaggagtccaagaacaggccggccaacatggtggaatcccgtctctactaaaaatacaaaaattagctggacgcctgtaatcccagctactcaggaggctgaggcaggagaatttttccctgtaagcgggaggcagaggctgcagtgagtcgagattacaccactgcactccagcctgggagacagagcaagactccatctcaggaagacaaaaaaaaaagcctacatcaaggaaaacagaaccaaaacaccagggacaaaatggtacataagaggcaaaaaaaattttcaccaaaattattcagatgaaccataataaatgtgcctgcatctgaagatgttctaaaccttcatttaagcaagaagcaagatcaagatccgttccgtcagttacctggagtctgtcatctttctgaataggggacagaatcacctcaaatttaactaataaaaatttatgacttggcaaacaccccaggtatttttattgactaacaaatcagctatgacaatcttagcaacaaatcaagttatgctatggggtatgtccacactttcctgttccctctacaacaggagaaaatcaaatctttccaacatcctaacaaactgttactccctgtaaccaaatgtatcacagtatcgtctaccaaggcgttacatcctgaaactttcctacaaaaagcacagcttcaaagaaaccttgcaagctttcttgtaagctcctcccttcccacatcgcccctccccagagccaagaaataaagcacttgaaagaaacaacatggataatatttattaatagcttatgtacatattccataactacataagccatttggcttcatacctgtcagcaatgaagtcagctggccctagcacgtggctgcgactcttctctatttatttagaactacaaactacaatttacactttacaaaagctgtaggactatttgggaaggcactttattcttctaaaaggttactaaattctcttaaatacttatactgatcacaatactgaaaaataatagaaaatccattgtcattcatttaccacctgatttgttagatgccagataatcaaatttcacacatttcaataaaaaggcaaaactaagcatgtcaatcataggaagaaaaatacttaactaattttatttaaagcactcacaaactcttaagtggtacaagacaagtcaacgctgtttatcgaacaatattttttttttacgactaaacatctcaattctagactcaggcactaattattaaagtcatctagttatatacaccaattctcaacagacacagttttttttggaaaggcatattaaacagactaagatgtgtactacccattagccaaagataattttattgatttttctaatgagtcttcaaatgttacattctaacatcttagcaaattatttccaaatactgctggaattacatgtaactatcaggaaacaaaagggcttctcaacaacttgtgcgttctacattatctggccagtttccggacaattataatacaattgtgctccaaagtaggagagttccatgaatcaattgcccctaaaatatatttctgtatatttaaggagttctaagcattgggttaaattccaaacagactctgaatacaagcatttatttagtaagagaggttagaataaatcaatcctaaattaggcacagctgccctccccccattgatcaaaaagacaggaaattacatttatttaaaaagttaatgttcctaatatattcaaatctaactaagccccaaaacggtctgagatcaaatcctccataaaagaggaaattctctagacttctaagtgggtgcccaaagagttcactcaagtgtccaggtatgaattacgattcaccagagtaaccggccttgcacttagggaaaacttccatcgcccaagaccagagtgggtcgatcccatcaacagtcacacaatctcatctcatgctccactaatgaatgttctgcctaaagtcagagcaatgccttggctggagttttgttttggttttttcaatattaccacgtgggggtcacagaaagggaacagaggttacaagagctctcacgtggcggctgaaagactggggaaccgagaaagtgaatgagtaacagggagggtcctggactctcaggatctcccaactcggggtcagggggaggcggtaagtggaatgcccccccaccacccccgcctctttctcacctcctggtcccgaccctaggccagtgccaccgccgggagccccgggtctcggcttcagccccaggctgaacatgcagggaggggagaggcacttaggcctcgcctccccgtggccttcctcccccagccggggcggaggagaaccaggaagccgcgcccggctccggtgggtggagggcctaggccgcgcctcccagccccgcggccctaggcctcggcccgcccgaggcggagcccgggaggtcggggcggggtcccgggccggtcacccacctgggttgccagtcattccagctccgcgaatagttggtgccgccgctgctcagccgagaccccggggctctgcggctcattaccttccccgacacgacatggccaagcgccgccgcccagagaagcgcgagtcgccgcccgaaccggccgctgccgacaccccgctccggcccggggctgaggaggaagccgaggaggaggaagagaaggaggaggaggaggaggaggaggaggaggcggcggcggagggcggggtaagaggacggccgttccgggttccgcctgagcccgcaacgcagaatgaggaggcgggagcggcgcggtgagagagaggcggatgaaggggcgccgacttctcttccagggccatgcgcggcccacgacgccggggccccggaggacgaggacgacgaggagcaggcggtggcggcagctccccacgctcacaaggccactgcttccccgcctcccggctccgcccgccgcgccgccactgtcgcacggcatgctgggagcgagaggcggggtcggccccgccgggcctggggagagaggcgggtcctgtcggcggggcggggccgagagaggcggggccgatagcaggccgccccgccccccacggccccaggctcttggacggcgaagaggtctgggcgtagtagtgacgaatcctaagacaagggatctccactactgcggccacacacttttctcccaaacgcttcccggaaagcaccggagggctgggcagtcaggtgtaaacaggcgtccaatcaaggacctgcagtgtgggtggtgggggctggtgccctggggtgcgagcgcacacaggcgtgcccttggtttcacgtgcgccagttttcccactttctacgggggggagtggaaagtgaaaatagtaagatcgagaggtggatatccaccttcccaacctccacctgaaatgtgcccatcgagtcctagcaccttttaccatttcttcccaatgaaaaaaactaaacgatgtaagggaagggagtacccacgaccaccaaaccctgtcctctgcaatgtgaaatgtgctttgaagtcctctcaccctgaggcttgcccgccttctgctggtgaaagaagctgggggctaggcgcggtgggtcacgcctgtaatcccagcactttgggaggccgaggtgggcggatcatctgaggtgaggagttccagaccagcctggccaacatggagaaaccccgcctctactaaaaatacaaaaattagccgggcatggtggaggacgcctgtaatcccagctacttgggaggctgaggcaggggaatcgcttgaacccagtaggccggggttgcagtgagccgagatcagaccattgcagtccagcctggacaacaagagtgaaactctgtctcaaaaaaataaaagagagagagagaaagcagggagggaagaaaaaggaaggaaggaaaggagggagggagggaaggagggaggaaggaaggaaaggagggaggaaggaaggaaggaaaggagggaggaaaggaaaggaaaggagaaaagaaagagaaggccgggcgcggtagatcacgcctgtaatcccagcactttgggaggccgaggcgggcagatctcgaggtcaggagatcgagaccatcctggctaacacggtgaaaccccgtctctactaaaaaatacaaaaaattagctgggcgtggtggcgggcgcctgtagtcccagctactccggaggctgaggcaggagaatagcgtgaacccgggaggcggagctcccagtgagcagagatcgctccactgcactccagcctgggcgacagagcaagactccgtctccaaaaaaaaaaaaaaaaaaaaaaagagaatcagctgggtagaggagacgtacctgaccatctaccccatgacatgtcccatgccccagggaaaaaaattccctaaaccatctgatgcataaagtgaatgcatacacattttttaaaaggtgggccaggatgctccttaaacaagtgtctaaaccttatctgcataaggagtcttaacctatcattttatgttgcaaagaaaacgtctttatatatcgcttgtgcaattaaaaattgtaaccaaaagtacttgaagattatgaggagttgacacctccacacacatgcatatcccctccaccttgggctccttgcttatggccaccaatccctcactaagggaggatcctgccagttctaaatgatggggactacaaaaattacccggcgtggtagcgcgtgcctgtggtcccaggaactcaggagggtgaggcaggaggatgacttgagtccagcaggtggaggctgcagtgacctatgatcccaccactgcactccagcctgggctgcggagggtagggagggagggaggagaagaaagagaaaaggcagggcaccatggatggctgactcctgtaatcccagcactttgggaggccgaggtgggtggatcacttgaggtcaagagaccagcctgacaaacatggtgaaaccccgtttctacaaaaaaatacaaaaattagccaggcatggtggcgcacacctgtagtcccagctatttggggaagctgaggcatgaggattgcttgaacccgggagccagaggttgcagtgagccgagatcgtgccactgaactccagcctgggtgacagagcaagactgtctcaaaaaaaaaaaaatcatttaggtgaagtgattcatgcctgtaattacagtgatgggaggctgagactggaagatccttgagcctgggagttataggccagcctgagcaacatagtgagacccccatctctacaaaaaaaaattaaatttttttttttcagacggagtttcactcttgtggcccaggctggagtgcaatggtgtgatctcagctcactgcaacctctgccttccaggttcaagtgagtctcctgcctcagcctcccaagtagctgagattacaggcacatgccaccatgcctggctaattttgtataaaaatttaaaaaattttaaaattagacaagttagaaattgcttgagcaactggacacaatctctggtactacctttctttttcttttttatttttttattttattattattatttcttgagaaggagtctcgctctgtcgcccaggctagagtgcagtggcgcaatcttggctcactgcaagctctgcctcccgggttcaagccattctcccgcctcagcctcccgagtagctgggattacaggcgcccgccaccaagcccggctaattttgttttttgtatttttagtggagacagggtttcaccgtgttagccaggatggtctcaatctcctgacctcgtgatccacccgcctcggcctcccaaagtgatgggattacaggcgtgagccaccgcgcctggccctctttttctttattggtcaaaatattatccaactaggcatatggatgtggaggcatgcctgtgatcccaattacttgggaggctgaggtgggagaatcgcttgagcccacgagtttcaggctgtggtgagccataatggtgccgctgcactccagcctgggcaacaggatgagaccatttcttaaggggacggaaaaaatcactctggctgtggcagatttccttaggatagattccgagaagtggagttattggggaaaaggctgttaatgattttaagtctttggatacagactgttaagttgctttccaggaagtttctgccaatgatagtctgatactttctgtgtcctcacaccaccctttgtcaacactgagtgttttttgagggttaattatttctatgggagaagttaaaaaaaaaaaaaagacaacaaagaaattgcttcaggtggggcatgctggctcacgcctgtaatcccagcactttgggaggctgagatgagagaatcacttaagcctaggaggtggaggttgcagtgagcctagatcgtgccactacactccagcctgggcaacagagtgagactccatttcaataaaattaatcaaatgaatcaaacgtgagcaactctcataacttccaacatttttttcttcttcctgttggtggttctgcctctctggctccattaggatttccctactccatttcagtcatgggaaccgagtttctgttcctgaaacacaccaagcctttctggcctctggatttttgtacttgctgttcccgccatctggaatgccttccctgcatttgttcccatcagggttgggactagcaaagtgacaggggatggagttgctgagggtgcaaaatttaaggaggcacctactcccagggtcatgcaaaagccaactttgcatttgcacaatcctgtgagtgagtccctccttaaatttgaggctgtactgtaatcccagctactcaggaagctggggcaggagaattgcttgaacctgggaggcagaggttgcagtgggccgagatcctgcctttgcactccagcctgggcaacagggcgagaatccgtctaaaaaaatgaggctctagacaccacatttgccctactctggcccctgccctgattttcctggcctgtctcatctccagacaggtttgctttgacctccctgcccataaaagttggccagtgccctttccaggtactctgtcatataccctatttctttccttggtagtacccagcaccatctgcaagtattgggtttctttgcacatttagcatctgtccaacccttaggatatcagctttgcaagagcaaaggtcacgtctatctcagcctacctcctccatactcagcacacagcacagcacctgaccataggaagcacgcaagaaatgggaggaatgaaatggaaattatctaaaataaggatcaagattgatacagaagtattcatctcagctttacttattaatagcaaaacaaaaacaaaacacctggatattatactaattctcaacaataggaaactgattaggatgcagtacattcagagctgaaattttctgcagccattacaaattacatttgtgaagatttttttttttttttttttttttttttttgagacggagttctgctcttgttgcccaggctggagggcaatgtctcgatctcggctcactgcaccctccgcctcctgggttcaagcaattggtctgtcattttcagacccaacagaaacagaggtgctcctgccaggcccccggggactgcctccaggagtcatttgtaatgacagggtgcgttctgcgcacagtttcagagtctgtccaaagggccaatgctggggctgggcagaaacgatccaaggcctgtgagctgtgcagctttataggcaaatgaagatcgtttacccagaattgcctgctggagacagcatagaggaagtggcggcaacttcaccagttccaggaagcccaggcagcctggtcccccagggtgcacctggcacagcagttcgcatggggccagagagcggcagctgaccgctgcaactacagctggcctgacaccgggcacaggtaccagcccagcccagtcccgcccagcgcagcctgcggcccctagccgaaccagcacctggcaaacctgacacccagccttggagcttgggcccccctctgcagctggctggggctcctgagacagcttctttgtcggaatccactcagtacacacacggtcccaaacttagtggctgcccagtgaacatggggcttagtagaaccagtaccttcctccctggccccttcaagtctaaatatcccctgctctgagtacaagcctccaccttctccactgatagacagcccccaccatctccaccgacagacagcccccaccttctccaccgacagacagcccccgccatcttcaccgacagacagcccccaccatctccaccggcagacagcccccaccatctccactgacagacagcccccaccttctccaccgacagacagcccccaccatcttcaccgacagacagcccccaccatctccaccaatagacagcgcccaccttctccactgatagacagcccccaccatctcccgtgtcatcccctggggggacttgtaaaagcagtggtcggggagcgggatggaaacccagagcttctgatcaggcaggtcgggggagagggagacaacacatctgcacagaacaaggtcccagggaggccggcgctgctggtccagggagcaccccccagcacaggcgcgtgcttccctgatggacacgtcaccacccctgggctccagaaaatgaatgtctgacccagtgacccctgtcctcacccaaggccaacctcaccccagaatgggctggaatgctgagcctgcccatgccagctccagatccacccacctccccaccattgctggccacagagagaggtcaaagtggtccagaaaccccaaggaaaatgaagcagttccggggcagggaagcaaaggcagtgtttccattttttttttttttttttttttttttttttgagacaaagtctcgctcttgtcgcccaggctggagtgcaatggtgcgatcttggctcactgcaacctccacctcctgagttcaagccattctctcacctctacctcccgagtagctgcagcctctgcctccggggatcaagtgattctcctgccccctgcctcagcctcctgcctcagtagctgggattaccgacacctgccaccacgcccgcctaatttttgtatttttagtagagacaagggttcaccatgttggccgggctggtctcgaactcctgacctcaggcgatccgccaaccttggcctcccgaagtgttgggattacaggcgtgagccaccgtgcctggccaggatggtctgcttataatggctcaattttgatgtccagtctctgcagagcacaaggcccccgctttgggccagacatacagatgtccctgggcaagaacagagatgatcccaaggccctggccccacctgtctgctcagtgttgaatcaggtttctgtgaaaacaaattactaacaggctggtgtcacattttcaaattctgtcaccagccgttgaacacatgtctttgtacttttttccatttttaaccggggctgagttacgcccaaccacactgtcctggctggcacgggggaggaggtgtcagctgctgtccagaatggggctgacacattcattttaaacaggccaggaagatgcagatttggcaagctctgaaatttgccgacaccccaagtcaagggtaagcaggagaaccggaaaagggcagcttctcatgtagtcaggttctcctgatgcaagcgtcctggtggatttgggtttcccaagggtcctgactccaggagacccccaggaccgacaggaagggccacccctccctctgaaactctgaagccaggccacccagtgctgaaatgctgtgtgaactcgggcaagttcctttgcagggactgagcctccctttcatgtctccaacagactggaacactgcctcccgttgcatgggcgaaatacctcgcggacatgtcttacggcgccccatgaaagcatcaccattaatctgaccagtcactgcagcatgagtatcttcagggcacagatgaagccatgggcaccagtgataaggagttgccactgctggctaagtgcggagcctcacacatctgtggcccagaaacccataccccactccaaaccctctatagctccaacagttatgctaacaagaaaaaggagtgaaaacccgctccagtcacggtattgtggaggtggaaggacacttgtggcagccaatccaacacctccattttatagctggggtaaacatagttcagagaggttgtcccacttgctgaaagtcacacagcagttcctgggcggcaaagtgaggacatccaggtctcctaaatctcaccctcgtgctctgcccacttaactaggcttttcaatcctggctgtcaaagagaagcaccaagtccacttgggctcctggccagcatccaggccagtccaactcaacagcaagcggaagcaaataccacacaatgaacttgttgaacagactctgtgctcaggcttaaccagtgcacagcctgtacacccgacaggcggatgcagctgttccaaactaaggccagggcctctccccaatcccgatgggctctgcaggtgcagtgatggaagaatccctggtgacggggagcccttagctctgagcaggacctgaagccatctcagggcttgcaccggtccagatgctgctgcacaagtgctccaggggctcctgccctgccctcctcacttgccccctcacctgtcagggatgtttgattcctggctggcccctcccctacctgacccctgccaaagacctacgccaccccaggctcccagctctgaagcaaacaaccagagaagtcaagcgcctggctccgggccacacagcttgagggactcagagctccagggacagtgcccgggccctgctcaggccttctgcagaggctctgggctcttccagttgactcagctcacagggcccctacacagtaccaggtgaagacacagccccaagaaccctcagggtctgaagccacacatgtgagccgtgggcagaatcctgcattggcctccagcagctcgagagcacagggacaaagctggactggccccggggtcaccgtggccttggttttgtagcagctgcagtttgagcacgtacaccaaaaataaaattctaagccccgtaactgactgaagggaccactcctattggccaaagggatattccaaagttaacctgaaaaacgagctcaggtcatgatgggaagaggggtcacacaggccttgttataccccctccctctggaattcaggtacagctgaccagcactaacattcaaacacagatcttggcctggctcagtgactcatgcctgtaatcccagcactttgggaggctgaggtgggcagatcatgaggtcaggagttcgagaccagcccgaccaacatggagaaaccccatctctactaaaaatacaaaattagccaggcatggtggcggcaggcacctgcaatcccagctacttgggaggctgaggcaggagaatctcttgaacccggttgcagtgagccgagatcatgccactgcactccagcctgggtgacaaaaacaaaacaaaacaaaacacaatattggtctccacaacctcctgtcttacccagatactcctttctattgattccaggtctttagctaataactctttcaaccaattgtgaatcagaaaatattttgccaggcacggtggctcatgcctgtaatcccagcactttgggaagccaaggtgggtggatcacctgagatcaggagttcaaaaccagcctgaccaacatggtgaaacccccgtctctactaaaaacacaaaattagctgggcatggtggtgcatgcctgtagtcccagctactcaggaagctaaggcaggagaatcacttgaacccaggaggcggaggttgcaatgaactgagatcatgccactgcactccagcctgagtaacaaaagcatctcaaaaaaaaaaatatatatatatgtatatatatgtgtatatatatgtatatgtgtatatatatgtgtatatatgtgtatatatatgtgtgtatacatatatatatatatataaaaagaaaaaagaaatctttgaacccacttgtgaccaggaagcccatccctgccttggagttgtcccgcctttcttggcagaaccaacaaatacctttcatgtactgactgatgtctgcctgtaacttctgtccttgtacaaggtatgaactccagctgtggcccagcccctggggcacatgtcctcagggcctccaggccttggtcctcacatttgactccggataaacctcttcaaatattttacagactctggctttctcgttaacaagcagctcacacatatagtgtctcagcagtgacagatgctggcccaccccgaggtcaggatgactcagcagggattgagtttgcgggcgtcatgctccaaggcccggaataggaggttggtgctcattcctcacatagtgggcaaatcctagggcaggggagggggggcaatgccagagaatggtccccacctggggcggtctgacggccagagatgcagagaaagagacgcctcccacgctcctggagggcaggtgctgtggccaccccggagggtccgccttccagagggagagttcaggatttggccacaatcagggaaggaggcactgggggggggccctcctgttggaaaagggcagcggcaggaagggggtgctgccacagggcctctggggagcgcgcgggcacacagtaccaatctgcgtgcatacacatgccctgtccctgcagatgggccacgcaaggcctgcccatggccagccatccaggtgatgctccagggagggccaggcctacttgggggcagaaccctgtggctgtccaggatacctggatgtgagtctgggaaggatggagaagggtggaggagtgcgaagggcccctaggggttgctggggaacacagatgagcctctgacccacctgtgtccttacctgggccgactgggccacccagtcttgctgacacctccccagacccctggcacccaccagactccccaggcgtggctgtgtgctccgctatgcctgatgacaaacagtggcctcagtgtagaggtgggcactgtggcccctggctcctggctcgctcctgcctcagtttccccagctctaaattggggattatcactggcttcaaaggctggagtggaaagtggtggccaagaggtgccaagaggtggtgcaagcatgtgccctaccttggacacccctctacagggggtggctctcaccctggcctgggccctcgggggtctgcgcagcccactcttctgtgtgaaggcggctggtacactttcctgggcaagattctgcacattctgctggattatgaaagaggtctgtgacccaagaaaaaagggtcagaagtgcccgttaggctctcctgtgtggctcaggtcatgtgcttctgtgaactccccctacggccttgccccgaatcccgtgatgcagcgtgacctgcccaggcgccggcggcactttcatgtctggctgggaaagtcggatttcagcactaatcactggctgccgcctgcaatgagcccacggcttgagctctggggcccacccagctccttaaacatgcagaacctttgctagctgagccagggtcccagctgtgcggggttggggatggaggggtgcagggatcccaaaacccaacccggggccaggttttacacaggcctggactgagaagtggggctacaggctacaggtgcttgataccctgggggggccctggaacaggcctggactgagaagcggggctacaggttacaggtgctggataccccaggggggtgctggacaccccaggggggcagatagaggcagccaggcagcctgaagaccctggggcaaaacacacacaggccccctctgctctctggtcactgctaactggccaactggcctttgagtccactgaccacagctaagcccacagccatcaaaacccaccccttacacccttcaccctttagggaggggctcagagacagttgtggcgattcctacttccacccacagccccccgaccctgggcctgtgccgagtgtgggtgggtgacatcatctcgcacccagagctccagactaaaggaaaccctggctcctgtctctggctcttccctccctctctttgttcccttgctccttccttctttttgccaaaggagaagatagtgaggctgagggctgctcaacgtgcacagtgagcaggagatacaagcatgtggagggacggtcacagcccatgcaactggcaccttcacacgcggaggcctgcgattcccagacacctggcgctggggcaaatcccattccacagccagaaacaggctcggcggggccaggtggatttctcaaagccttggttgcttttggcctgatgctagctggacaatgtctcagctcacaggttcctaaacgcacacccgcccacaccaatctgctgaggagtgacagccatggggaggagacccacctcactccagggaccctggcaccgtctcccatgaggccaggtgtcctcagccacccgcagccagagtcccgcgagaccgacggacggcctgcccctgcgtgacggcacgcctgggactgtcccagcaggctcccatgcttcacccaactgcgacagggaaacaggagggggctacttctgctttcaaggcatggaggagctgtctgcaggccacttcccgaacacctatgcgcttggggaactgactgagactgagccggggtatcttctccacgatgcggtgagcccatcaggcccttcttctgagagcacctccctggaggtggaagcccctgaggcccacagcatcttctgaacctgtgagctcccacttatttactgagagctcacctgggccagtgccggtccacggctgtggccgggactttgagtagatgctaccctacttgctatgcagagccagctggggcccagggaggtcagataactgcccaaaccaaatccaggcccagccagaatctcaactccagcctttgcgccttctgataaaacccagcatcgcttgaatttccagtacacgctgccaagtcttcgttaagcaataaataacccacacaaccctactgtcatgacaagttccatatggccatccagaaagagacacatagagctggttcctctcacctttatgaccagtgaaaagcgcaccaacacgaagacacgcgtgaaaggacctcatctcctaaccagactgacaagcaagggattttttccactcaccgtcagtgggatggttctaagcaccgaggccaacccatttcacacgattatttcacaaaaagaaactttctgtgggacgtgcctgggctactgaaaagacagccagcaaaactgagaaccttgttctcaaatccgtaccctctcccaaagcagcctcagaggcccgagggctgaggatccagacccgaaagccactgtaccttctgtaggatcaggctcaaggactaagggggtaaaaggtgccctttcccttcctaagcagaaaattctggaacccaaccttacgtgtgatcatttaaaaaaaaaaaaaaatcagctgggtacactggctcacacctgtaatcccagcactttgggaggccgaggtgggcggatcacctgaggtcaggagttcgagaccagtctggccaacatggagaaaccctgtctctactaaaaaatgcaaaattaaccaggcatggtggtgcatgcctgtaatcccagctactcgggaggctgaggcaggagagtcgcttgaacccgggaggcagagtttgcagtgagccgagatcatgccattgcactccagcctgggcaaaaagagcgaaattccgtctcaaaataaataaataaataaataaataaataaataaataaataaataaaatcactttctatggcttttcactgctccaggaacaatgtccacagataaaacgcccagcctctccttcacaccctggagcgcccatcctgcccactggtccgggctccaggctgccccctgcacctgtcagaagtccccctacaagggcagggtctcccttcctgggacatccactgcccttctccgagctgaagtcagaacgacctgagaatcagcttggagttctaccagcctcagccaagcccacctctgcgacagcactcctttcgagggggcaccagctgcagggagtctgtcccttacagacccgtgaccccgtgacagatgaataaagtacagacacacagatattctgctctgccagtccagctgagggtcccagccgcttataggctccctgctgagtcctgtaaacagttgctacttggccctgatcagctagtcagacgcgcatttattcagtatgattaattaacaaaagcttgagtcaacaccattagagtgtaacagacattgtggacttcccgagtaaaaagcatttaagcacccagggtcttaagattatatgagtaaacaagctagctaggtaaactactctgcctttcttttatttctatgtttatttgtttaactaaaggtaaagggatcaggccgccttcagccagagctaattaccaaagttatgccaacttctcggccttccaagatttgtgtctatttctataactatctctaatatctttcccaccagaatgattgaaccccaacacacctccgtctctcagcagggtctgcctgttcagagaacacaacttctccttcttgccttacacacaggggcaagaataggttcacccttgcagagagcacatccctttctgttactgaaaatcactttccaaaaaaaaaaaaaaaaaaagcaacacatacacacatactcaccacatacacaggtgggtcagagaaaaaaaacaagtacaaatggcttagggacatgagaagtgtggccctaactttcgctgaaagggatcctattaacattaaccctcacctctgggtcagagagggttggcactctacagcctgccttgaggctttacctactgggaccaaaaggactgctggaaagctattttaggccgggtgcggtggctcaagcctgtaatcccagcactttgggaggcagaggcgggtggatcacctgaggtcaggagttcaagacaagcctggccaacatggtgaagccctgtctctgctaaaaatacaaaaaattagctgggcatggtgggcacctgtagtcccagctactcgggaggctgaggcaggagagtcgcttgaacccgggaggtggaggttgtagtgagccgagatcacgccattgtactccagcctgggtaagagcaaaactccatctcaaacataaaataaaataaaaataaataaataaaaatactttttaaagccctattaccacaaaataaatccaggaacgtgtgacttggtacagcctctttggaaggcacattagctattacattagaatccacaccccgccgggtgcgatggctcatgcctgtaatcctagcaaattgggaggctgaggcacatgcccgtaatcctgcacaggcaggagaattgcttaaaaccaggaagcagaggttgcagtgagcaacgagcctgggcgacagagacagactctgtctcaaaacaaaaacaaaaacaaaaaacaaaaaaccacataaccttttcccatttgcacaaagctgggaaaccccaaatgccctccacaggggtctacggggggtcagggggtgggggcggtgagcacacttgttcctgccgacacagggaagtcttcttagcagctaaagagggcagcctctgcgtaccgcctgggaacatggcaaaaccattttaggcttaaaaaaaaggtggagaacaagttgtacattatgatcttttaaataaataggccagcgatatatttgtaacagaagcagctctggaagcgtacactgtcagccacagaaactctggggctggggggtggtaaaggaggagaaatgtgtcacccaggcaggagcttagtggcaccatcttggctcccgagttcaagcagttctcctgcctcagcctccgagtagctgggactacaggtgtgcgccgtcacgcccagctgatttttgcttttttttttgagacagagtttcgccttgttgcccaagctggagtgcagtggtgcgatctcagctcactgcaacctccacctcctgggttctagtgattctcctgcctcagcctcccgagtagctgggattacaggtatctgccaccacacctggctaattttttgtatttttagtagagatggggtttcaccatgttggccaggctggtctcgaactcctgacttcaggtgatccgcctgcctcggcctcccaaagtgctgggattacaggcatgagccacagtgcctggctggtttgaatttttaaatgatgatgaattcatgtatgactgatgtgatttttattagaaagagaaaactaggcagcgccccatcctatgtctccttcctggtggccaatgaagcatttcccacaactcactcctggcaccaacaggaagtcagacactcagcacccaggggctgctttttttttttttttttttttctttgagacaggcttgctctgtcacccaggctggagtgcagtggcaggatctcaactcactgcaacctccacgtcccggagcatgcctcagactcataagtagctgggattacaggcgtgagccactatgctcagctaatttttgtatttttagtagagatggggtttcaccatgttggtcaggctggtctcggactcctgacctcggtagatctgcccatcttggcctcccatagtgctgggattataggcgtgggccatcacacccagccaacagggatccattttttaaaggtaagagtgcaggctgcataagctattatccatgtcgttacataccaggcggacatgtacctaggcgggagggagactgaaccagtgaaattctaatgacaaaaaaaagaaatcagagtcatcccttacattcacatgtccaacgcccagctggaagccacaggctctccccactcctgtcctactacgatttttcccggctttgacctgcatggtggtgcggctgctccgctcagagcctcagagaaaccacacagagccctgctgagtcttgccctcggggcattctcacatttatgaagaaatgcctccccctcccccttctccccaaagtacggtgtggcagaaaacagcgccaacaggtcctgccagtcagaagccactcccctgatttcatggctcaagaccccaactgtaaattagcccttcccaccttgaatatgtacacacactactgagatccaggccgatccttgccatgggatgaacctgagaattgccaagacccgccttcccacgccacccaaccaaatcatgtggtatctggtacaagtgattttccccctgaaatcccacaagaaaactattttgaggccgggcacggcggctcacgcctgtaatcccagcactttgggaggccgagccgggcggatcacaaggtcaggagatcgagaccatcctggctaacacggtgaaaccccatctctactaaaaatataaaaaaaattagccgggcgtagtggcgggcgcctgtagccccagctactcggaaggctgaggcaggagaatggcgtgaacccgggaggcggggcttgcagtgagccgagatcgcgccactgcactccagccagggcgacagagcaagactccatctcaaaaaaaaaaaaaaaagaaaagaaaagaaaactattttgaaaagcagttctctctggcctggtgaagaacacaccagcaccatgcccaccaaaacaggagccccatggctgtttcccagagtaacctgggacccgcacgtccattcactgcaacacagactgaatctgcagccaagctccgctctctcactactgggcaaccctcaggggggatcccttagcctaaaccagcaccagtcactacccgcacacgattttattactactgttttcttatgagtcagcccgtgtcactgattcctgacgagctggtgtggagagcagaaatgaataattttcttttcaactgcaatttccttttcaacaaccagtcagcaatcggagctttaacaataaaccggttgctcagttactccacgtgggtgccacgcaagaggctgggagtattgctcagcggggccaacgggaggctggcacttgcctgaaccgcttaagtgggggaatgaaatgcccaccgaagggcagggcagggaccctgctgtcccgtcactgaagatattcccagcccgtggggagaagtgtaaacgaatgaatgaaagaaacgcacgtggtttctgggaccaatgaccttagcctagaactgccgggacggtccaggaacgcaaaaatgtagagatgtgggagccaggggcgtagtgatgcaaggatgcagggacccagggaccacgacctcccaacccccggcccgcgccccgtactcacgcacgcagtggcaggccatgagcttggctgcctcctcgggcaccgggcagctggggaagagcggcttgagcaggtaggtggcgaagaccagggccacgatgtactgcgatgaaggccggatgacgagcagctcgatccagagcttgaggaaggcgggcagcgagccgtagacgtccagcatgtaggcgtagtcgccgcccgatttggagatggtggtgcccagctccgcgtagcagagcgcgcccacgatggagaagacgccgcacgcggcccacatcaccagcgccagccccggcgagcctgcctccttaagcacgcccgtgggcgtcacgaagatgcccgagccgatgatggcgcccacgatgatggccacgccgttgagtagcgtgatgttccgctgcagggtcacgccctcgccctcgcctgccggcgccgcgccgtccgcgcgcttggaggccagcatcttctcccgcgcctcttccttctcctcggccaccggggccgctagcgcccgccgcttcgggcccgcacccgccatgctctgcttaccggccgggcctgggacacccgagagccgcagccgagcgaggattgtgcgcgccgctcgccgcccgcagctgcgtcaagaaccccgcccgcgccgccttttaggccccggcccgctggccccgcccaccgtccgcggctcctccccgccccgtggcccggccgcggctctcagccccgccccctcgacccagctcggagcacgtgcgtcctccggcctagcctggcaggcgattcccaggcccgcgtggtcctcgaaggcccccgtcctcctgcgccatggagaccccggcctcgcgacctacccccccggcgcccgcgtcatcccaccccgtcctcccgggtgcgcctgggcggggcctggcagtcagggcgagccccttcacccactggcccgcagcctctcgtcaagcctgggagcgggcagtgcaccagggctggcctgaggccaaggatggggtttggggtaccccccgaagggaacctaggctcctgtcccggatgggcctaggggatggaaccgcccccacaaccagctcctggggcacgggggagggatgagaggatgacctgaggggaagctcctgcagcctccttccagcctgggggctgcatcaatgtggctggtgagccgcgaactgagacgagggaagaaccgaaccgaggccacccagtaattcccattgtatcccaaaagaatcttgccaaagatggcgatccggtgcccgtagctttgagaagcagtaataacacaggctttgggaagccagcaatctgcctgagctcaatttaatcaacagaaccgggggttcaccgggagccataagacccccacccccaaatctagctggggaattcaaaggcaggcttcagtgtgaaggggctttaaagcttgttattcctggggaatgcgagaggcatcttagctaaaaagggttgagaggtaatttcagttagaggcgagagcaggatgccaaggctcctaggcctggaaacgggaaggaatataaatactgccccgagattgaccagactggtgagcagccaaagacctcttcaaagggtgtgtgtgggtcagggaggaagctcctcggtatcacccccacccggggttccttggcgtgtgtcctaacgagtccttggaagctcacagcaggcatgtggggaggcctttgttctgggtgagcgttcagcctcccagggcaaacacgcaaacaccggttgcagagctgggtgttcacagcaagacagtctgctgggcagatgcctctggaatccacagaatcctgaacaatagccgtggtggagggggggtcagaatccctgtcatgctgggacctctagctgcagccaggaatgtccaggccccaccccggggaggaggcggctgaggaatgccacggcttgtcattctggaccttgctcgccccccggtatggcgggcattcctctgcagtgataaaaccaagcgaaatctcagcagcccaggcagccaccggcaggggagtgcggaggtcacacagatactaacttgtaatctgccgtccacgctgctggctgtggaaggtgcagagagccctccatccgccctattcttcccgctgtgcctgcagagggaaggagacagtaccaccatggctgggcaaactcaccgagtgctcactgagtcctcccctagatagcttcttgtgcaatagggtaggtgccagttaggagcaaggttagagattgtagggccagattttttgcttaggttcaactacgcaaaataaaaatagactttgcatgcatttcaggcactgggctgacgaccggccaccagggaggctccgccccacttcttagctttggccccaacgttagtcttgttgctgctctcaggcgtgctctgcgtgtgaaagatgacttggaggctgggcgcggtggctcacgcctgtaatgccagccctttgggagaccaaggtgggaaaatctcttgagcccaggagttcaagaccagcctgggcaacatagggagaccccgtctctacaaaaaatacaaaaactagcccagcgtggtggtggtgcacctgtagtcccagctgctggggaggctgaggtagaaggatcacctgagctggggaaggttgaggctgcagtgagctgagatcacaccactgcactccagcctgggtgacaaagcaagactccatctcaaaaacaaaacaaaacaaaaaataacaaaaaaaaagagggtgaaaggcagccccagagtgggagaagagatttgtaaaatggacaaaggccttataattggaatatataaagaactcctaaaaatcactaagaaaaccacagacagcccaagagaaaaatgggcaaatggctcaagtaggtgtctggtgaaagaggatatgcagatggccaatgaatctgcacaaagtgctccacatcattaatcattagggaagtgcaaattaaatccacaggagacacctgggcacaccctccagaaagcacacaatgacctgctggcaaggacaggaacgaccactttggaaaactctttggcagcacagccaaactgagcctttccactcgaaaatgccctttgctcagaacccagcagcagctccaaagtctccacccagcctatcgggccccagtacccacccttgcctcccatgcctctctcctcacccctgcacttggctgcctcaccctcgggctgcaccttgaacaccagaagggcgctcctgcctccagcctctgcctggaattctctgccctcgggtagccatgtggttcactcctcctttggtctctgcccaaatggcccctgtagaagagacctccccacccagccatgtcctctccctgtgacttaccaccccagactttctgtgttgatgcatcgtggtctacctccttccgtcagaacgtgagctccgaggcaaaggctcttcagacctgaaacagtctaggctctgtccccagagtctagaatagagcctgccatgtaattggcactcaataaatgttacatgaattaatggaaaccatcctggcacgagtggtagctctctttccaccaaaagaatgagcttgccaagagagagagacaacatcacgaaagagagacagaaaagccacactcagacccaactttgagttctggatcaagtctttttttttttttttttttttgagacaaagtttcgctcttgtttcccaggctggaatgcaatggcgcgatctcggctcactacaacctctgcctcgcgggttcaagcaattctcctgcctcagcctcccgagtagccgggattacaggcatgcaccaccaagctcggctaattttgtatttttagtagagatggggtttctccatgttggtcaggctagtctggaacttggcctcccaaagtgctgggtttacaggcgtgagccacagcgcctggctcctatgttattttttaggagctttattgttttacctttcctatttagatctatagtctgtcaggaattaatttttgtgtgtgctgtgaggtaggggtgtgaggtatggtgagaaaaaagattcatggttccccatttggatatcccgttggctcggtggggtggctcatgcctgtaatcccagcactttgggaggtcaaagcaggagaactattggagctcaggggttcaggaccaacctgggcaacataatgagaccctgtggatcaacagatgaattgatcgatcaatcaatacgtagatagataagtatccaaatgatccaaaactattcacagaaaagcccaaccattccctacagcatgactcagggatcacaaatgtgtggaaccttctagacatgctattctttttcattggttgatttgtccttctctgacaggtaccacattatcttaattaatatagctttttatttttatttatttattttagatggagtctcactctgtcgcccaggctggagtgcagtggcgtgatctcagctcactgcaagttctgcctcccggattcaagcgattctcctgcctcagtctcctgagtagctgggattacaggcatgagccaccgcacctagctaatttttgtatttttagcagagacagggtttcgccatgttggccaggctggtgtcgaacttctgacctcaggtgatcttcccacctcggcctcccaaagtgctgggattacaggcatgagccactgcgcctggcctactatagcttttgaaataggtcttgacatcaaattgtgtgtgttttctggttttatcctgccagattacttttggttgtatttttggtagagacggggtttcaccatgttggccaggctggtctcaaacttctgacctcaagtgatccacctgcctcggcctcccaaagtgctgggattacaggcgtgaaccactgtgcctggcctcacaagaattcctttttattttgagacggagttttgctcttgttgcccaggctggagtgcaatagtgcaatcttgactcactgcaacctctgcctcccgggttcaagcaattctcctgcctcagcctcccaagtagctgggattacagacacgcacccagctaatgtttgtgttttttatagagacagggtttcaccgtgttggccaggatggtctcgatctcctgacctcgtgatccacccacctcggcctcccaaagtgctgggattaaaggcgtgaggcaatgcgcccggccaggagtttttacaaggaggaagctgaagctggaaaggcacggaaaaggatcctcccctagagcctcagaaggaagcagccgtgcggacaccttggtgtcaggcttctggctcactgaaccgtaagagaatcagtctccattgttttaagccaccaagtttgtggtactttgttacagtgaaactaagcaccctgcacttgcgttgggtgccatggcacacccctccatcccagcgttatgttccccacggtacttacacatctttctttcacttgcagctgaaacgtactttgactaaaacaataacctcattctctctttttaatttcagaagtcacgtacaatcacattgtgaaacttgggaaacaacgcttccttccttcaaagtcagttctgctattcatgtggacctaatgtctctaggatcttgtgccctcattagtggcctggaaggacgcccagaccttccagttcatcaggggttgaagtggacgatagttgttcaccgtcatcttcttctcttcaccaagtgcagaaaacaggagagtacgaaatgcagagagctggaatagagggcagccagggtgagcttggtatgagtgcagggtgagccagcccccaggtgtccctcaggccttgtgtggtctcctcccatgctgaatcaggatggcccgaaatgaccagtaaagatggtggaagtgatggtgtgtgcagggccagcttataaaaggcattgccgcttccgccttggtctttaggatcacttgctctggggggaagctggtcaccatattgggagggtactcaagcagccccgaggagaggcccacagggagaggagctgaggctcccagccaactgccagcgccaacttgccatccacttgagagggccaaccttggaatgaatcctctagccctagttgagctttcagatcgctacagtcccagctgacactgggctacaattcatgaaagatggtaagccagagccacccaaattcacaacccaaggaaactatgggagataataaatgattggtttttgttgtcattgttgttgttgtttgagacagtgtttccctcttgtttcccaggctggagtgtcattggcaagatctcagctcgctgcaacctccgcctcccaggttcaagcaattctcctgcctcggcctcccgagtagttgggatcacaggcatgagccaccatgcccggctaatttttttttttttttttgagatggaattttgctcctgttgcccagactggagtgcaatggtgtgatctttgctcaccgcaacctccgcctcctgggttcaagggattctcctgcctcagcctcctgagtagctgggcttacaggcatgcgccaccacgcccagctaattttgtatttttagtagagatggggtttctccatgttggtcaggctgctctcaaactcctgacctcaggttatccacctgcctcggcctcccaaagtactgggtttataggcgttagccactgtgctcagcctaattttgtatttttagtagagacagggtttcaccatgttggtcaggctggtcttgaactcctgacctcaggcgatccactcgcctcggcccccaaagtgctgggattacaggcatgagctactgcacccggcccaaatgattgttttctaaagccactatgttttgcagctatttgttacacagcaatagataactaacacctataatgtaaatgctaaagtaacatttgaatttacttttcactcaaggaactaaaagactactttttatggctggatgcggtgcctcatgcctgtaatcccagcactttgggaggccaaggtgggtgaatcacctgaggtcaggagtttgagaccagcctggccaacatggagaaaccctgtctctactaaaaatacaaaattagccaggtgtggttgtgcatgcctgtaatcccagcactttgggaggccaggtgtggtggctcatgcctgtaatcccagcactttgggaggccaaggtgggtgaatcacctgaagtcaggagtttgagaccagcctggccaacatggagaaaccccatccctactaaaaatacaaaattagccagatgtggtggctcatgcttgtaatccagctcctcgggaggatgaggcaggagaagcgctttaacctgggaggtggagcttgtggtgagcgagatcacgccattgcactccagcctgggcaacaagagggaaactctgtctcaaaaaaaataaataaataaaaaataaaaaaagactttttatgtattatctcacttgttcacagaatatacttacgaactctgtgaggcaactcacacatttaattaaattcagaagtgagattatgtctacatgctgacagcatactgggccagttagccctgcgtgatgatccagcgccccctagaattgtgcgcgcatggtgcacctggcctcctgggccatgaccacagtgtgctcatccacatttgtggtctgcacatttgttgactgtctcagaaaggcagcctttctcctcccctggaaaactccccgccttccaggacatgtgcctccctggctcccctgctcaggataaggggctcctgccctgcatttttatatgacaccggccaccctggcttaatactattggcttcgtttctactttcctgccagacagcagtattctgagacgaatgccctgttcctgtgccgcccctccacacctgcccccctcccaccctctcttggtggcacagacccagaatgggcacttgtcacatatatgcttgttgagtagcataagggccttgctgacaaggggccaccttcaacaaaagccttccccatgtccaacagctctggtttggaggtaggcagatattctgcatcccacatctccacgtgcaaatgacatcatgccatggtttgtatataagggaatattttcacaggcccaggagactgaaagaccctctaagagctcacctggagccctcagaaagagatgagccagagatgctaagtcctgctgcgactgctgagaaatgtctgccgggcgggggcggggcataggcagcatgcctgtggctctgaactgccttggacagacagaattgctatagattcttaagatttccagaaaaaaatgatagtataacttttatttattttttattttatttttttgagacagtctcactctgtcgcccaggttggagtgcagtggtgccatctcagctcactgcaacctccgccttccaggttcaagtgattctcctacctcagcctcccaagtagctggcactacaggcacacgccaccatgcccggctaatttttgtatttttatttatttatttatttgagatggagttttgctcttgttgtccaggctggagtgcagtggtgcgatctcggctcactgcagcctccacctcccggcttcaagttattctcttgccccagcttcccaagtagctgatattacaggcgtgcaccaccacgcctggctaattttgtagatttagtagagacggggtttcaccatgttggtcaggctggtctcgaactcctggcctcaagtgatctgcctgtctcagccttctaaagtgctaaaattataggcatgagccatgacgcccagcccaatagtataacttttaaaaatgtatacaaggattattaactaattttcgaaaaaaaaaagcaatgaaactatttagataagaaaaaggaggccgggctcggtggctcatgcctggaatcccagcactttgggaggccaaggtgggcagatcacctgagttcaagaccagcttggccaacatggtgaaatcccgtctctactaaaaatacaaaaattagccaggcgtggtgatgggtgcctgtaatcccagctactcgagaggctgaggcaggagaattgcttgaacccaggaggtggaggtagtagtgagctgagatcgagccactgcactgcagcctgggcgacagagcgagactctgtctcaaaaaaaaaaaaaagaaagaaaagaaaaaggaagaaaacaaaaaccatgcagacccatgacgctgggacaactcccatggatgccttgtgtgtctgtgtgtgatagattagggcattgctcagaacatgctcgctgtgatcactggaaccgctgtccaatctcaacaagctcctacttcaattggaactttcttcttgtgtaagaacaccccaaatgcatgaaagaatatatataactcctcaaggctcttatgcagcatcttagtgacgctgccaagcaagagagacgccttccatgaagcgccatcatgccagttacgggcacggctcacttggcttggggccacttcaacgggctccttctggatgatccaggtgaccgactcggtcagcggcggggtggtgagcgagcccacataggtccagtaatcccagcaggtgggcagcagagcggaggggtcgaaggggcgcatggccgcccgcgcgtcctgagagaccgagaagccaaggccgtgtcagtcctcaggcgggactaggagcttccatcttgtctcagcacgggaggccttcatggtgcttggaaggaagtgctttccccgagataaggccatgaggccactgctgtcacacttggaagcagtgataagaaaatgtgacccttctatacagagcaaggattcctgccaacttacattggtgggaattacattacattacaccagcttatgttggtgcttacatttttccttttgaagtcatttcttggggcgcagtagctcacccctgtaatctcagcactttgggaggccgaggcgggtggatcacttgaggtcaggagttcgagaccagcctggtcaacatgatgaaaccctgtctctactaaaaatacaaaaattatccagatgtggtggtgggcgcctgtagtcccagctactcaggaggctgaggcaagagaatttcttgagcccaggaggcagaggttgcagtgagctgagatcacgccactgcactccagcctgggcaacagagtgagactctgtctcaaataataataataataataataattaataaataataaaaacgccatttcttttagcataccttggctgcaaaaaatattactttttattgtgataaaatatacataacataaaatttaccatcttaacctttttttttttttttgagatgcagttttgctcttgttgcccaggctggggtgcaatggtgcgatcttggctcactgcaacccttcgcctcccaggctcaagtgattctcctgcctcaacctcctgagtagctgggattacaggcacccgccaccacacctgctgattttgtatttttagtagagacggggtttcttcatgttggtcaggctggttttgaactcccaatctcaggtgattcacctgcctcagcctcccacagtgctgggatgagaggcatgagccaccatgcccagcccatcttaacaatttttaagtgtaaagtttcatggcgttaaatgcagtcacattgtggtgcaaccatctccaccatccgtctccagaacttttccatcatcccaaactcaaattctgtcctgaccccactaaacactatgtccagcttcctcccccaggcctggcacccaccattctgcttccatctctctgaatctgaggactctggggacctgatgtgggtgggatcctgtggtttttgtcttttgtgtctggcttatttcactgggcataatgtccttcaggtttatccacattggagcatgtgtcaggagtccctgcattgttgctttttttttttttttttttttctgagacggagtctcgctgtgtcacccaggctggagtgcagtggtgtgatctcggctcactgcaagctccgcctcctggagttcaagaccagcttgaactcctgggttcatgccattctcctgcctcagcctccccagtagctgggactataggcacccgccaccacgctcggccaattttttgtatttttagtagagacggggtttcaccatgttagacaggatggtctcaatctcctgacctcgtgatccgcccacctcggcctcccaaaatgttaggattacaggcatgagccaccgtgcctggcttgcctggagacatttctactgctaccttaccgatcagggtatccagtatctccgtgattaccttcatctgtccctggaaactgtgcctgccaccctacgctgcagccgtccagggactggcaggcctcggcctaaaggtctggagggtgggcgacctgcaagactcacaagaggggaagccaacagacatacctatagacggagtgctgtgcccctggtgccgacaagaaagccaaggctcgggctgggtcagcaaccgaattccagtttagaggcagatttggtcgtggacatggccagccacctcagtaaaattagagaggattattttgcattgaatacactcacagccaaaaaacaaaaaaaaagagtcagggtcttactttgtcaactaggcaggagtgcaatgatgccatcatagctcactgcagtctctaattcctgggctcaagcgatccccccgcgtcagtctcccaagtagctaggacaccataccagggtttaaaattaattgtttgtagccaaggggtcttgccatcttgcccaagctgttctccaactcctgggctccagtgatcctcctgccttggcctctcaaaatattgggattacaggcataagccactgtgcccagccagctcttttggatatatacccagaagtgtgtgattgctgaatcatagggtagttctatttataactttttattttttttatttttttgaggcagagtctcactctgtcttccaggctggagtgccgtggcatgatctcggctcatggtggttgggcctggccgcaacacagccttcatcagcatcccatgccaaccaagcacaactctgcacctgtccctggccagcactgtgggacaagagtccagtccaaagtgacagagtccctgtctgcaaggaagatggcctccctgctcagccacatcacatcaccttgactttgctgggccctggccttccaaggtggaagccggcaacctagatgccttgggcttgtctcctaacatcaagcagtgagggtcagggtcaagagaggtggctgagctaccagaaggaagcccaggagtgtccacgccggcagacacatgcatcagttctgtgcacacgtgttcacgtttataattatccagttaattaaaaaaaaaaaacagcattataggctgggcgaagtggctcatgcctgtaatcgcagcactttgggaggccaaggcaggcagatcacctgaagtcaggagttcaagaccagcctgaccaacatggcgaacccccgtctctactaaaaatacaaaaattagccaggcatggtggcaggtgcttgtcatcccagctactcgggagactgagacacaagaattgctttagcacaggaggcagaggttgcagtgagccaagattgcaccattgcactccagtctgggcaacagaaagagactcggtctcaaacaacaacaacagcaacaaaacccacagcattattgtgatagaattcacataccatgcaactctcccatctaaagtgtacaacctggttgggcgcgatggatcatgcctgtaatcccagcactttgggaggccgatgtgggaggactgcttgaggccaggagtttgagaccagcctaagcaacataacaagaatctgactctacaaaaaatacaaaaactagccaggtgcagtggtacatgcctgtggtcccaggtagttgggaggctgaggtgggaggatggcttgagccccggaggttgaggctgcagtgagctgtgatcataccactgcactctagcctgggtgacagagtgagatcctttcttaaaataagtaaataggccgggcacagtggctcatgcctgtaatcccagcactttgggaggccaaggcgggtggatcacctgaggtcgggagttcgagaccagcctgaccaacatggcgaaaccgcgtctctactaaaaatacaaaattagccaggcgtggtggtgcatgcctgtaatcccagctactcgggaggctgaggcaggagaatcgcttgaacctgggaggcagaggttgcagtgagctgagatcatgccattgcactccagcctgggcaacaagagtgaaactccatctcaaaaaaaaaaaaaaaaacagaaaaagtaaataaaaaattgaagtgtacaattctatggttttgggtatattcacagttgtgcagccatcccaagtcaattttagaacattttcagcacctcaaggaggaagcttggtactttttagctcttctccccacccccgccgtgctgcttctgtctctgtgggtttcataggaactgagtcatgtaacatgtggaacatttgtgtcttgcgtctgtcacttagtatggtgcttttgaggctcacccacaccgcagcgtgagttagagctgtgtcctttctgattgccaagtaatatctcattgcatggtctagctgggttgacatcccattgcacactctagctgggctgtgaaggagcaggctgcttgtgcacatgggtaacggatgtacagtgagacgtcagtctgtgcacatgggtaacaggtgggtgcaccgtgaggtgttagtctatgcacatgggtaacaggcgggtgtgcagtgagatgtcagtctggtgcacatgggtaacaggcaggtgtgcagtgaggcgtcagtctggtgcacatgggtaacaagtgggtgtgcagtgaggcgtcagtctgtacacgtgggtaacaggtgggtgtgcagtgaggcgtcagtctggtgcacgtgggtaacaggcgggtgtgcagtgagatgtcggtctatgcacatgggtaacaggtcggtgtgcagtgagacgtcggtctgtgcacatgggtaacaggcgggtgtgcagtgagacgtccgtctatgcacatgggtaacaggcaggtgtgcagtgagatgtcctctcctcctgccggccacacgtccccgctcccagggcacagatgtgccagtcactttctgagcaactacttcaaatcttcagaacaacccttcaagaagtatttctagtttactgatgaagatagacagacagatataaacaacttgcccaaagccatgttgccagtcagggccactgaggcctggccctttccaaggtgcgggctcttctctccctccccaggactgcaggaatcagtcgggggagtggcaggccccagccattccactgcgtgcaggtttcctgccaattaagctttccagccttgggctgagaagaggatgcctgtgtgttgcctcatcgtccccaggagttcctgtcctgtctctaagatgcatgagagctggagcagccatgtggttacagaaagctgctccccctcagggcccccaaaggaagtcagggcccttcctttatgcgtgtggtgagccccaggcagctagaatgggacaccggtgagcacaccaatgaggctgaagaccatcacatccattatctgagcacggatggcccagctacctgtggaaagcaccacaagcctttgctggcggaagtgggttggtgacttgttccacttttctcttatttatttatttattttgagacggagtttcgctcttgttgcccaggctggagtgcaatggcacgatctcggctcaccacaacctccacctcccgggttcaagcgattctcctgccttagcctccctagcagctgggattacacgcatgcaccatcacgcctggctaattttgtatttttaatagagatggggtttctctatgttggtcaggctcatctcaaactcctgacctcaggtgatccacccgcctcagcctcccacagtgctgggattataggcgtgagccaccgctctgttcctggttttgtcttctttctcttaaacaggaccccgcattttatgagcgtcaagcctcacccagcctaactccgcccttggtttgtcctcttagagtctcagtttccccaggtgtacgacaggcagtgtggtggctgtaatgggcttccatcagtgcctgccacatgggcgtggggctcggtaggtgctgccgctgctgctgccaaagctagaagagcccccacagggcatagagccattccctggatcccctggacctggtgggctgtttccaactccacaaggcagccaattccccggtagccctgactcttgcgaaggcagggaggaggggggaccccagcagcctgaggagcttgcagcttgtccaggcatggagggtggggaccctctgtgggcagtttttgccaaaacttctggctatggtgagagggtcaaaggcgaagcctcgaggtctccattctgggagtgtctgcccagggtcaccggggccacactggggctgggcctgcgtgctgggagctgagtgcatagtgacaggtcggcactggtaggggcctgtgcagatgggacggcgctgggggtgggggtgggggtccgggcttccaggcggcgcctaatgtggttttggttatagacactgcctgtgtttccctctaagctgctgaaaagctcagaaatgtgcagcagggcctggagctcagcctgggttctgactgcatgtgggaggtgggcgctgggacgactgggagttcaggctgcatggacccacttcctgggtttaaaaacgggctcttcacctgccacctgtgtgcccgggcaaggccttctctgcctctctgagctttggtttccctgtgtgtgcaagacagatgaatcacaggccctgccccgtggagtgattggaagattcagtgtgataatttatatggagggctgtcgcttctttgaacccttcccaccgaggtgtggggcgatgtccccttgccctgagcctgggcaggtgctcctggcgggagtggtgaacaggatgccgcaggagcagtgctttgtgactctggaagccagggcagaaaagacatcgtgtccgtctggctctttctggaaatgcacccttggagccctgagcactgcatagaagccagctgggtccccagggaatgaccgtggcaggcattcctggagggtctctgccgagtcagtcccacagcagggcccggaccagcctggaactaggagagatgatggggactacgtgactctggtctttcctgccctagttcaggacagcttgttccttaactggaggaaaccaggaaaacagcccagaagctgcaggtgagcccatccctgggtgaggactgctgagtccgcgggggtgagaggcagagctgggatttgaagccaaggccatctgcccttgagcctgaggccaccacggccccgtcctgccctgcactgcccaccaatcaggagttagattcaaccacacttctagcattttccatcagaaggccatcattctaaagtttcatggactcccaaaaggtaatagctctctctgggaatcagctgactgaaagcacccgcagcaacaaaaagcgactttaaccttagtgattgggctggtggattttcgtttcgtgacaggcagcagcagcctgtgcattccacagcagacgtgtgtgtgtgagtgttggccacagctgggccttaaactcaactgcacatttcaccaagaaccagacatgctccttattccattacatggtgagaatgctgctctagtgtggatttttttttttttttggagacggattctcgagctgtcacccagactggagtgcagtggcatgatctcggctcactgcaacctccatctcctgggttcaagcgattctcctgcctcagcctcctgagtagctgggattacaggagtgtgccaccacacccagctaatttttgtatttttagtagagatggggttttgccatgttggccaggctggtcttgaactcctgacctcaggtgatctacccacctcggcctccctaagtgctgggattacaggtgtgagccaccgcgcccgggctactgtggatgtttaacatctccatttcacaggtgaggaagctgaggctcagaggtgcgcagctcaggagtggtggatcagggctctggacccaggagtccaactgtggggctctctgatacactgtgctatgggagaagctcccagaagtcctaggctaggagcctctaggcgagagggttgttcaagtctcttcccattccctgacccatgaagcatagactcttgccccgaaggctgggtcttttacctcctaaggtctttttttttttttttttttttgaaatgagtctcgctgtgtcactcagcctggagtgcagtggcacaatctcagctcactgcaacctccatctcccagattcaagcaattctcctgcctcagcctcccgagtagctgggattacaggcacccgccaccatgcctggctaatttttgtagttttagtagagataggctttcaccatgttggccaggctggtcttgaactcctgacctaaggtggtctgcctgctttggcctcccaaagtgttaggattacaggcttgagccaccgcactcagcctcttaaggtcttttaatttctcaaaggtctaactcggccaggcgcggtggttcacgcctgtaatcccagcaatttgggaggccaaggtaggcggatcacttgaggtcaggagtttgagatcagcctggccaacatggtgaaaccctgtctctactaaaaatacaaaaattagccaggcatggtggtgggcgccggtacttccagctactcaggaggttgaggcaggagaatcagttgaacctggaaggcggaggttgcagtgagccgaggtcgcgccattgcactccagcctgggcaacatagcaagattctatctcaaaaaaaaaaaaaaaaaaaaaaagagtctagctctttattttcagctgaggggatgagcccagagatcagcatcaggaccagagctcagtccgcggtgcacttcctcccctgtcccgggcatcattcctcccctgtggtttgcctagaaaattttgacttaccccatggggaagaaatgctccagaaccttccccaggaggaaaacagcccttgggtaaagggtccttcacagccagctcttttctttcccaccaagaggtgggaccacctggtgtgggaggtggaggctggctgggaaaacaacccctccccaggtttcctctggctgtggagccgcgcggaggaagaggatggggcgtcagagctctcagaaccgtggccttgtgaagtttctgagcaggcaaatggggcggcggggggtgatctggtcccagccccaggaggccgccccgaagccagcatcaaggcgaaggccacgtacagatcaaacggctccttgaaccgcgaggaagggctcgccccagctccatctggaccagcccgcaccattgttaacacaggttgaagcctcatccgtccgcacatctgaggcttgcgttgactccttctgccctggaattcttttgtttgctgctgaataaataaactacatttctttggaatttctccttctccctcaaagccttttctcagctgatcttggagaaaggcgacactcttgtccccgccatcttttcgagctgtgctggatgcagggaagcgtatggagagctgggcgctggatgcagggaagcgtgtggagagctgggccggagagccgcggtttgggcaggtttctctctgcccttgggcttggggtcggacagggacgttcaaggagatgctgggtggtacatgagtcaacattcttaaatgttattagttagggatttgaggtttttgtttcaatctgttttcaaacaaactttatcattagtgaatatcatcacccaggacaaggctaaaaatttttcgagctaatcaatttaaagaaaaatattaagtaggctgggcgcggtgattcacgcctgtaatcccagcaccttgggaggccaaggcgggcggatcacctgaagtccgcagtttgagaccagcctggccaacatggtgaaaccccgtctctactaaaaatacaaaattagctgggtgtggtggcgcacacctatcgtcccaactgcatgggaggctgaggcaagagaattgcttgaacccgggaggcggaggttgcagtgagccgagatcacgccactgcattccagcctgagtgacagagggagactcctcgaaaaaataaaaaagaaaagaaaaatattcagtagaaagttgtcccattggcaggcagatatgtcaaagtcttcaggatcttgcctgcacgactgaattttgggaacttccattgagcccaacacccttattttatggaggaggaaacagggtcccagagcagtggtgacgcattcgaagtcaggaagagctagctgtggacacacgagcatcaaccctgcggaatcctgtttccagaactggaatcacagcgcctcggcggggctctttccactatgagatttctttttccttgcaaatgaatcgctgcactaaacaattttgcttgtcaaattatgctgatttcttttctttttttttttttttttttgagataggatttcactcttgtcacccaggctggagtgcaacagcgcgatctcagctcactgcaacctccacctctgggttcaaacgattctcctgcctcagcctcccgagtagctgggattgcaggcatgtgccatgacaccctgctaattttgtatttttagtggaggcgggatttctccatgttggtcaggctggtctcgaactcccgacctcaggtgatccactgcctcagcctcccaaagtactgggatcacaggcgtgagcctccgcgcccggcctgctgatttcaaatatgcagcttaccttatgttttacttccagcaagacgtccaccagcctctgcagcatctgatgatgggccccgagctgcgtggcagacacacaaggggttagctgaaaaggcagtgggtggcggggggaagctcactccactataaatacaccacgttttaaaagcaatcctaggccaggcacggtggctcacgcctgtgatcccagcactttgggaggccgaggtgggcagatatctaaggtcaggagtttgaaaccagcctggccaatatggtgaaaccctgtctctactaaaaatacaaaaattagctgggtgtggtgacacactcctatagtcccagctactgggaaggctgaggcaggagaatcacttgaacccaggaggtggaggttgcaatgagccgagaccgtgccactgcactccagcctgtgtgacacagcgagtcctgtctcaaaaaaaaaaaaaagcaatcctaatgatggatcaccactttcttcattagatctacaccccagcaagcgattacctttaaaaacacgcctatcacagaaaccattctctcccacgacagcttccttgtaattttggtatttcacagaattccagtgaactaaatgcagctgaaacacaatggaaagagaacttaaattgatcagcaagaaataagacagtcacttccccttctgaatggctgacctatgtgtccacttaatcataatgaaatggccaggcgcagtggctcacacctgtaatcccagcaccttgggaggctgaggcgggtggatcatgaggtcaggagatcaagaccatcctggctaacatggtgaaaccccgtctctactaaaaatgcaaaaaaaaaaaattagccgagcatggtggcgggcgcctgtagtcccagctactcaggaggctgaggcaggagaattgcctgaacccaggaggtaaagcttgcagtgagctgagattgtgcctctgcactccagcctgggtgacagagcgcgactccgtctcaaaaaaaaaaaaaaaaaaaaaaaaagaactaagttgttgcagccagatgtgtaagatcccagcactagcagcacctctgagctcccaggcacttgatgaagccatgggaaggaagagcctcagtcttcctggtggtgggaaaaaggagaggatcatgttaacctcatccaatagaaatgggtggtttcattattttctacttcctagttatccttggacaaggattaccagaaaaaactcacgcctcggctgggcgtggtggctcacgcctgtaatcccagcactctgggaggccgaggcgagtggatcacgaggacaggagttcaagaccagcctggccaagacggtgaaaccccgtctctactaaaactacaaaaattagctgggcgcggtggcaggtgcctgtaatcccagctactcaggaggctgaggcaggagaatcacttgaacctgggcagcagaggttgcagtgagccaagattgcgagatcgtgcgatcgcgccactgcactccagcctggggaacagagtgatactcagtctcaaaaataaataaataaataaaatatctgttcatcaaaaataaagttgcagatagagatactaaaataaaaggcatgttgttaaatgaaaggaagcacacagaagccattgttgcgctcattcttggaactatttataaatatctgtatgatgatgacaatagatatcactccctatttataaaatgtccggaggtcacctctgggtgtgcgattacaagcaattttcattttttggtttgggtgcactctagttccacattaactgcagcattactttcataacaacaacaagttcaaaaaacagaaagagtcctcaacttgaaaaagcatcaagaagtcaggtgagtgggtgagcagaggtgtgataaagtgaatatggcaaaaatgatcatcacaggactgagacgtcaaactcatagattcttcttgttcatttcttttcattttttcgtatgttgcaaaaatttcataataaaatatttggggaaatctataaggcatcacttatcacccaaaaaaactacaaaaaccaattcccagcattgatctgcactcattttctctactgactcccactttggaatgttgaaaataagactgctttaagaagatgatcttggccgggtgcagtggctcacgcctgttatcctagcattttgggaagctgaggtgggtggatcacttgaggtcaggagtttgagaccagcctggccaacatggcgaaaccacatctctactaaaaatacaaaaattagcagggcctggtggcacgcacctgtaatcccagctactcggaaggctgaggcaggagaatcgcttgagcctgggagatggaggttgtggtgagccaagattgcaccaatgcactccagtctgggtgacagagtgaaccctgtttcaaaaaaacaaaaaacaaacaaacaaaagaagatgatctctattgcaaagatgttcagcttctcagcggagggccttgtggatttgctagtccctacagctgcaagcacacagctgagtgaagcgtggcaaagagctcaagctctgactttgaatcccagctgtctggctttggcaagttccgtaaccattcagaacctcagtctcttcttccgttaaatgagagaacttacagtgtcttcttcgtaggaggggggtgtgaccaaacgggtggggcggccgacggttctggtttgagcactgacagtcccaggccccaggaaatccttcacatctgagcggcaggcatggcttgttcaccccccaccatagagccggagacatggaaagcgtccagatatgtgctgttaggccacgtctacaaacctctgcggggtacacgtggccgtccactgtgtgctctgagcccccctcgttcactgctccccagtggaagtgaaattgcttcagtctgtagtggttttccaagggcccgccactaattcctggaaataaaggcagcgagacgtgtgtgtcattttgtctgtttgttgagctgtggtgttacctgaggcattgtctacattagggttatatgagttcactcgcaaggggttgctgtatggttgaagtgacaagccaaaggtgggctccgtgaaaggtgggctctgtctgtcccattcactctgccccccgccagcccagcgcctgcccagaggttcacagtaaatgtggaatgaaggcagggtcccagtgctgccactgggtggtggtgagggcctcatctccctgcaggcagaaatcggtaaagaaagtttctgagatgcctgcctgtcctataagatttccagactttaatttaaaaaaaaaagatgtcttccaaatattttttaaaagcagcttaaatcctatcaccaaataacattataaaataacacaatgagcaaagtttttgttttgttttgttttgttttgttttgttttaagacagaatcttactctattgcccaggctggagtacaatggcatgatctcagctcactgcaacctccacctctgggttctagtgattctcctgccccagcctcctgagtagctgggattacaggcatgtgccaccaggccaagccaatttttgtattttaagtagagacggggtttcaccatgttggccaggctggtctcaaactcctgatctcaggtgatccactcgcctctgcctcccaaagtgctgggatgacaggtgtgagccaccgctcctgggtgagcaaggtttttaaataagcagaccctgagctatagcatcagtcctgatctctggcagtccctgcttaatctaggcccaccacagggccagcttttattggaacactccttccgtcctaagtcaccctaaacactcaccttggagtcagcgctctccacctgcaggccttggggtgcccctctccatggcacagtgccaggtgcagcctcccaggagcttccttctcctgacacgtggggctcagccataagcatcgctcactgaggcctctggctctgcctcacagagtcatggctgccatccccaggtccaggtagtgctgggagtctgccttttaacgagctccccaggggttctgatgtgggtggcttctcctgtgtctaagcactttgtcactaacagatttccatcaacagctgctacaaatgtggtacctattccacacgttttcattgaaaggagcacagtgtgctcctgggatggctgggcaaggctggaaggcgccagcagaactggagcactgatcacgaattcgcggtggcccgagtgcctcccgtagctgtggaggagcctcgtgtcacccgccttgctcatgtcacctcccactgtggcaaaagccaggaaaacactgagcgcatgacaaatgccttggggagcttgacagtgctgactcctggtggtttcctgacaccaaaagtacttgggctgggcgtggtggctcacacctgtagtcctagcactttgggaggccgagatgggcggatcacttgaggtcaggagttagagaccagcctggccaaggtggtgaaacccatctctactaaaaatacaaaaattagctgggtgtggtggcgggcgcctgtaatcccagctactcaggaggctgaggcaggagaattgcttgaacctgggaggtggaggttgcagtgagctgagaacgtgccactgcactccagcctgggcgacagagtgagactcagtctcaaaaaaaaaaaaaaaaaaaaaagtactcatagttggaggcaccaaggtgtaaactggaaaatggaaaatggatttggctttggtccagtcaggggctaggcaagtgctggaccaagccacagagctgctcactgcccctcttcactcaaaatctcagtgttggtctggagcaacctcggagtcatatctagttttaaaattctaccattatgagcaagtcttctagtctccttaaatatacacagatgaattacatctcaatttttaaaaatacacagaaagagtgcttcacacaataagcacattaaatcactttgttaggccaggcacagtggctcacgcctgtaatcctaacactttgggaggccaaggcaggtgtatcacttgaggtcaggtgttcgaaaccagcctggccaacatgctaaaacctcgtctttactaaaaatacaaaaaattagccaggtgtgttggtgggcgcctataatcccagctactcgggaggctgaggcaggagaattgcttgaacccgggaggcagaacttgcagagagccgagatcataccaccgcactccagcctgggcgacagagcaagactccgtcttgagagaaaaaaagaaagaggccaggcgccgtggctcacgcttgtaatcccagaactttgggaggctgaggcgggtggatcacaaggtcaggacatcaagaccagcctggccaacatggtaaaaccccatctctactaaaaatacaaaaaattagccagatgtggtggcacgtgcctgtaatcctagctactcaggaggctgaggcaggagaattgcttgaacctaggaggtggaggttgcagtgagccaagattgcatcactactctccagcctgggcaacagagtgagaccccgtctcaaaaataaataaataaggccgggcgcagtggctgacacctgtaatcccagcactttgggaggccgaggtgggcggatcacctgaggtcaggagttcgagatcagcctggccaacatgatgaaaccccgtctctactaaaaataaaaaattagctgggtgtggtggcatgcacttgtagtcccagctacttgggaggctgaggcaggagaattgcttgaacataggaagcgaaggttgcactgagccaagatcgtgccactgcactccaccctgggcaacagagtgagactctgtctcaaaaaataataataataaataataaataaataaaataaaataaagtctactcttactcttaaaaaaaaaaaaagaaaaaaggccaggcatggaggctcacgcctgtaatcccagcactttgggaggccagggcgggcatatcacgaggtcaggagatcgagaccatcctggccaacatggtgaaaccctgtctcaccgggtgcggtggctcacgcctgtaatcccagcactttgggaggccgaggcgggtggatcatgaggtcaggagttcgagaccagcctggccaagatggtgaaaccccgtctctactaaaaatacaaaaattagccgggcgtggtggcacacacctgtagtcccagctacttgggaggctgaggcaggagaatcgcttgaacctgggaggcagaggttgcggtgagccgagattgtgccattgcactccagtctgggtgacaagagtgaaactccatctggaaaaaaaaaaaaaaaagaaaccctgtctctactaaaaatacaaaaattagctgggcatggtggcatgtgcctgtaatcccagctactcaggaggctgaggcaggagaatcgcttgaaccaggggagttggaggctgtggtgagccgagatcgcgccactgcactccagcctggcgaaagagcgagactccatctcaaaaaaaaaaaaaaaaaaaaaaagaggccaagcgcagtggctcaggcctgtaatcccagcactttgggaggccaaggcgggtggatcacgaggtcaggagattgagaccatcctggccaacatggtgaaaccccgtctctactaaaaatgccaaaattagctgggcatggtggtacgtgcctgtaatcccagctactcgggaggctgaggcaggaaaatcgcttgaaccagggagtcagaggttgcagtgggccaagattgcttcattgcactccatcctggcaacagagcgagactctgtctcaaaaaaaaaggaaatcttcctgcctcagctcctgagtagctgggattacagatgtaagctaccacatctggctccaatttaagtatccacatgtggctagttgttatctattggaacacgcagttctggaggctttaatatagggactccttatggagaaatggatatggttaaaggaggctacaaggaatgctgaagccctaagagactagcaactattggagcctgttactgcttctaggactgatggggtaacaggcagaaactgtgttaccgaaactcattaaaacctggggatgtagaaggggccacctgacaggtgctgcagatgtgggtggggagatgaagccactgccagagatgtgaggcacagcaggaagggagcagaatagaaatgtcctgactgtcctcccccttggagctccagccagtcctccctttagctaaactcaagtgaaatccaggccgggtgcggtggctcacccctgtaatcccagcactttgggaggtccaggcgggagttcgagaccagcctggccaacatggcaaaaccctgtctctatttaaaaatacaaaaaaattagttgggcgtggtggagggcacctgtaatcccagctatttgagaggctgagacagaagaattgcttgaaccggggaggcggaggttgcagcgagccaagatcctgccactgcactccagcctgggcaacagatcgtgactccatctcaaaacaaaacaaaacaaaacaaaaaacagagggtgggggagcctccagggcagagggtagggctgagaataggtctgggagtgagggtagatgatgaccagcccagagccacaaaccccaaaacatcacctctgaaccccagggctctgaggaaccctgtctgaaaccacttcctaggtgggacacatccaactgaacggaaacagaactgaacagatacgagggtggggggacccctggaggtcccttctgagggatctttgcttagttctgttctgttcctttcttttttcttttcttctttccttttcctttccttttctttctttctctttctctctctcttcctttcctctttccttttttttttttttttttaaccgagtctcgctctgtcacccaggctggagagtacagtggcatgatctcggctcactgcaacctccgcctaccgggttcaaatgattctcctgcctcagcctcccaagtagctgggattacgggtgcctgccaccaagtccagctaatttttgtatttttagtagagacaggattttgccaagttggcaaggctggtctcgaactcctgacctcaggtgatctgctcaccttggcctcccaaagtgctgggattataggcatgagccacctcgcctggcctttactgagttcttaaaggctgagacaggaaaagaaaaatagtaaactctgtgcgtaatttcactattttcttgtttaactttatgactgtcctggagagggcagcatcattacctttaatttagagctgggacagggacagtctgtgacacttatcttgatattgaggaatggagtcagtcctccaatggagggaggccgattgaggtgtgatactgagtgccccatcagttgttcaagggctggggcagatctaatattgtgtctgtactggctgatacttaggtggccagggccccagctttggaaacctgtgatggctgctaccacctctggctttgctaggcgcacacatctgcccagactcaatgtattgcaaacccatgcaacctccaggcccacactgagaatcaagaattgtggactcttgattctccaaatcttctcaaaagcccagctgctggctgggtacagtggctcacatctgtaatcccagcactttgggaggacgaggcgggcggatcacttgaggttaggagttcaagatcagcatggccaatgtggtgaaaccccatgtctactaaaaatacaaaaattacctgggcatggtggcaggcacctgtagttccagctacttgggaggctgaggcaggagaatcgcttgaacccgggagacggaggttgcagtgagccgagatcgtaccactgcactccagccttggtgacagggcgagactctctctcaaggcttgagggctgagtgaacactccttaactatttccagttatagccacgggtcgacttagatcaacagaagtctgtatggattactctaatagagtgcaaaaagatctgaactaggacctcattgtgaattcggatcctaccccttaccagctgtgtgaccgtgggcaagacacagaatctctgagctgtcactgccctctctgtaagtgaagtggcacccacttcttatgtctgtgttggtcctcttctcctaattgacactcactcgtttttcgttgttttttttttgagacggagtgtcgctctgtcgcccagactggagtgcagtggcacgatcttggctcactgcaagctccgcctcctgggttcatgcaattctcctgcctcagcctcctgagtagctgggactacaggcgctcgccaccacgcctggctaatttttcgtatttttagtagagacggggtttcaccgtgttagccaggatggtctcgatctcccgacctcgtgatctgcccgcctcagcctcccaaagtgctgggattacaggcgtgagccatggcgcctggccactcttttttttttttttttttttaactttgagatagaatcttgttctgtcacccaggttgaagtgcagtggcataatcctatctcactccaaactcaaactcctgggttacagcaatcctcccacttcagcctcccaagtagctgggaccacaggcacatgcccccctgcctggctaatttttaaaattttaagtagagatagggtctcaccgtgttgcctaggctggtctcaaactcctgggctcaagtgatcctcccaccttggcctccaaaagtgttagggttacaggcatgagccatggtgcctggtgacactcactcttgagttgagctcacacagacccctggctttaaatatcatccaaatgttgatgtcccccaagttttcatcttcactgcagacctcttctgtgagcttcagaactgctcacttgaaacttccccttgggtgtctgacaggcaacacaaacttaacatgtcccaacatgaactttttttttttgagacagaatcttgctctgttgcccaggctggagtgcagtggcctgatcttggctcactgcaaactccgcctcccaggttcaagtgattctcctgcctcagcctcccgagtagctgagattacaggcacgtgccaccacacccggcaaattttttgtatttttagtacagacagggtttcaccctgttggccaagctggtttcaaactcctgagctcaagcgatctgcctgcctctgcctcccaaagtggtaggattacaagtgtgagccaccgtgcccgggcccaaaatgaactctttatcttctcccccatacctgctcctcctgcagccttcccatatcagaatacaacaattctattcttacagttggtgtggccgaaaaccttggtgttgtcctcaatcctctctcacacatccccaaatccaatctgtcaagaaaccctggtgatcacttgagcccaggagtttgagaccaacctgggcagcatagcaagaccctgtctctacaaaaaatacaaaaatcagcggcagggcgcagtggcttacgcctgtaatcccagcactttgggaggctgaggcaggcagatcacaaggtcaagagatcaagacaatcctggccaacatggtgaaaccccgtctctactaaaaatacaaaaattagctgggcatggtggcacgtgcctgtagtctcagctacttgggaggctgaagcaggagaattgcttgaaccagggaggcagaggttgcagtgagccaagatcgtgccactaccctccagcctggtgacagagcaagactctgtatcaaaaaaaaaaaaaaaaaaaaaaaaaaaagctgggcatgatggcacacacctgtggtcccagccactcaggaggctaaggtgggagggtcgcttcagcccagaagttggaggccgcagtgagccataattgcaccagtgtactccagtctgggccacagaataaaactctgtctctagaaaacagaacaaaacaaagttgaagctctctaaactctccacactgactcagagtgaaagtgctaataatgacctaaagccgtgccctatggccccctttcctcttgacttcgcttttcatgcactctgctccagccatactggcctccttgggcttcccagaacacgcgaagcaggacccaggttagggcctttgaactggctttgtttgtccgtgggattccccatgaacatctcatggctgctccctctcttccctcaagtctcccctcagatgtccccttctcagagacatcagcctgtagaaaggagcacttccttcccccactttcctgcgtgatgtttctccatgatgcctgcttcctacatatgtagagtctgtctcactccggagaaggctacctccaagaggacaggtgactggcccttgatttcattaattgtcacaatcctatgccggacacatggttggtgttcaacaaatatttgcggaattaaagaacaaattaataatgttgtgagataaatactctgtgcccatttttctttactttttaatatattttttaaatctagagagacagggtctccctatggtccccaggatggcctcaaaactcctcctgccttggcctccttggctgggattactggactactactgtgccaccatgcctggctcttcttttccttttactatgcccattttaaaggtgaggaaaactgagactcagaaatgttcccaagggcacacagtgagtggtggctgccttcaggttggtctgactccagtgcccaagcctttctcaggagtggtgtgttgcccatcagccattatatccatgacatcaactggcataagatatgttcttatatgaaaattaattttagaagtgagtgtcacgaaatattgaccttctctaaggaactagttcttatagtcaaaaaggaggaacttatgtaaattttccctttcagggccagccccaggaagttcagagcctaatgtggtgttcattctattaattttttcttaccctgggacttttttctttctttcatttatgttaacctaatcaccagctgcttcctgttccttaggaaatagctaagtcgtacatgacacttttggggttccagtgtgcccggcatgggttttctttcattgggcaggcactaggtgggcttttcagcctgaagacgcatgtttctcatcagagtgagaatgatctctgatcattctccttcttccatttcttgggttctctcttcctggcactcctattggttagcttttgggcctcttggattgcctggctgtgtctctgtggcaaagactactcattatccaaaatccaatgagcccttcttccccaagaacatggtggaactgcatgtcccagcctcccttgcagtaggcatggtcatgtgactaagtttccaccaatagaatgtgaggaggtgatgtatgtgacttctggtctttggccttaggaagtaggccagcttcatactctccattcctgctggctggagatccccacaacagattcaaacgtgcaggtgacaaacggtgccctaccgatggcagaaaagtgatgaggaagggcccttggtccctgagcaatgagagaagcagagctgcctccctaactaccaccatttcacttgaacatgtctcttcttttgtttatttatttatttgttttttgcagacacgtctcttcttttttttttttgagatagagtctcactctgtcccaggctggagtgctgtggcacaatctcggctcactgcaacctctgccttctgggttcaagtgattctcctgcttcagcctcccaagtagctgggattacaggcatgcgccaccatgcctggctaatttttgtatttttagtagagacggggttggccaggatggtctcacactactgacctcatgatccacccaccttggcctcccaaagtgctgggattacaggtgtgagcaactgcgcccggccgacacgtctcttctttaagccgccacttattggatctctatgttagagcggcagtctcatatattttctctcatattttcttctccacccctacaccttctgggagttctattttctgggataattaattaattaatcaatttttgagatggggtctcactctgtcccaggctggagtgcagtggagcgatcttggctcactgcaacctctgcctcctgggttcaagctattctcctgcctcagcttcctgtctcaaactcctgacctcgtgatccacctgccttggcctcccaaagtgctgggattacaggcgtgagccaccgcgcccagctttatttattttttaaattttttattcttgagacagagtctcactctgtcacccagggtggagtgcagtggcataatcttggctcatggcaacctccgcctcccgggttcaagcgattttcctgcctcagcctcccaagtagctgggattacagacgcctgccaccacacctggctaatttttgtatttttagtagatggggttttgctacgttggccaggctgatctcgaactcctgacctcaggtgatccgcctgccttggtctcccaaagtgctgggattacaggcatgatccaccacacctggcagttttctgggataatttattaactttttattacaacacttcctgtttgtgtttgtacagatgaggccttgctatattacccaggctggtcttgaacttctggcctcaagccattctccttggcctcccaaactgcaggaattacaggagtgagctactgtgcccagcttctttattctaatgcttttagtaattcagtatcatagctttaatttctaagaattcagtctttgctctatttatttatttatttgagatggagtctcactctgtcgcccaggctggagtgcagtggtgtgatcttggctcactgcaacctcctcctcctgggttcaagcgatcctcctgcctcagctcccagaatagctgggactacaggtgcctgccaccacacccggctaaatttttttttgtatttttagtagagacagggtttcaccttgttggtcaggctggtctcgaactcctgtccttaggtgatccacctgcctcagcctcccaaagtgctgggattacaggcgtgagccactgtgcctggcctctttcttttttataacaccctgtttttattgtaacatagtgtagcaattttttttttctttgagatggagccttgctctgtcgcccagctggagtgcagtagtggatctcggtttaactgcaacgtccgcctcccgggctcaaatgattctcctgcctcagcctcccgagtagctgggattataggcacctgccactgtgcccagctaatttttgtatttttagtagagacagcgattcaccatgttggccaggctggttcgaacccctgaccccaggtgatcagcccacctcggcctccaaaatgctgggattacaggtgtgagccactgcacctggccagcaatatcttttttttttttttttttttttttttggggaaagagtcttgctctgtcgcccaggctggagtgcagtggcgcgatctcggctcactgcaagctccgcctcctgggttcatgccattctcctgcctcagcctcccgagtagctgggactacaggcgcccgccatcacgcctggctaatttttttgtatttttagtagagacggggtttcaccatgttagccagaatggactcgatcttctgatctcatgatccacctgcctctgcctcccaaagtgctgggattacaggcgtgagccaccgtgcctggcccatctttttttttttttttaatatggggtcttgctctgtcacccaggccagagtgcagtggcatgagcacagctcactgcagcctcaaatacccaggctcaagtgatcctcccacctcagcctccagagcagctgaaattacaggcacgtgctaccacgccctgcccagctaatttttttttggaagcagcaccttcatttattagggacttcggtggggatggggaaaggcggcccccgggtcagaggcgccggaagaagagcttggagccgtggtctaacgtgcactcgctggggcccagctggctcccgcccagctctttttttttttttttttttttttttttgagatggagtctcactctgtcgcccagactggagtgcagtggcgcaatcttggctcactgcaacctctgcctcccgggtttaagcgattctcctgcctcagcctcgagtagctgggattacaggcacccgccaccacacctggataatttttgtgtttttagtagagatgaggtttcaccatgttggccaggctggtctcgaactcctgacctcaggtgatccacctgcctcggcctcccaaagtgctgggattacaggcatgagctactgtgcccagccccgcccagctaattttttaattttttgtagagacaggatctcactatgttgccagggctggtttcaaactcctggtctcaagcgatcctcccgctttggcctcccaaagtgctgggattacaggggtgagcctcgtgcctggcctgaagcagcattttctcaaatgtctttaaaaataccagatttttttttttctttttctttttttcttttcttttcttttcttttcttttctttttttttttaagacggaatctcgctctgtcgcccaggcgggagtgcaatggcgcgatctcactgcaagctcactgcaagctccgcctctcgggttcatgccattctcctgcctcagcctcctggtagctgggactacaggcgcccgccaccacgcccggctaattttttttgtatttttagtagagatggggtttcaccatgttagccagaatggactccatctcctaacctcatgatccacctgcctctgcctcccaaagtgctgggattacaggcgtgagcgatcgcacccagcctctttttctttacgtaaattctgtttcctccaggattacttttcttttctttttcttttttttttaaatttttttgaatgtacttaggatgcatttggctacaaataactaaacatccgacttacaggaagctcacagaagggggtggctgggattcagggccccttgatcaggcatttgcgatgccttgggatcccatgctcttcctcccattcctcctctgcaatcctgcaatgtttccatcctggggccagttcctctcagagttacaggatgtatccttaatcatggcttgtgggaggcagaagttactgcccccgggttctcttttaattaaaaggaagaagcctttcttagaagcctcccttccttttatcttagtggctagaactggggcatgtaccctttcctaatgcaatcgtgggcagaaggggagtggttactttagactggtcagactttgctggagctgaagaaggaaggggtcagtgcccaggatgtgtatgctggtgggcacctgaacaaactggggtacttttaggaaagaaggaggcagaatggatgatggggttggtttatcttggtgctttcctttcatgttgcagggtttctttgaatgttgttgatatttcttccaggcgtgacggctcatgcctgtaatcccagcagtttgggaggccgaggtgggtggaatctcttgcgctcaggagttccagaccagcctgggcaatatagggagacctctgtctctacaaaaattagccaggcgtagcggtgtgcacctcccagttttgctgggaggattacttgagcccaggaagttgagttgaggctgtagtgagctgtggtctcaccactgtattccagcctgggtgacagagtaaaaccctgtctcaaaaaaaaaaaaaaaaaaaaggttgatatttctttcaagtcccatcatacttcagagtgagccaataagaggctgactggggcttttggtaccagagtagagctttccaacttgagggttggactttcatatcaagtgtgagaataaactaaagacctatttaggtgcaagattactttgggcacggtggctcacgcctgtaatcccagcactttgggaggctgaggggtgacgatcacctgaggtcagtagttcgagaccagcctggccaacatggcgagaccccgtctctactaaaaatacaaaaattagccaggcatggtggcgcctgcctgtaatcccacctactagggaggctgaggcaggaggatcgcttgaacctgggaggcagagtttgcagtgagccgatattgccccactgcaccccagcctaggtgacagagtgagacaaaaaaaaaaagcaaagttcacctttttattagggagctttctttggatgtgacttgaaaatgtgctcctgcaaaattaagagggtaaatcacaaaagagaagggtgcagactacaggaaataggagatcccacccaagagagaaataaccactggtcccaagatgtagcagtgtagcaacagggagtgggaggggagaaggaaggtcacactggagcaaggaattagtgaagcaattagaaactctaggtaaaattaaaagagatgtattgtagtaaatttactatgatacattatcgtagtaaatatcgctaaaattttatatatatatataaatatatatatttatataatataactgaacaatagttatataatgctttttttttttttctgaggtggcatcttgctctgttgcccaggctggagtacaatggcacgatctcagctcactgcaacctccgcctcctgggttcaagcgatcctcctgcctcagcccccctagtagctgggattacaggcacgcgccaccatgcccagctaatttttttatttttagtagagatggggtttcaccatgttggccaggctggtctcgaactcctgacctcaggtgatccacccgcctcggcctcccaaagtgctgttattacagacgtgagccaccgtgctaggcatttttttttttttttttttagagacatggtctccctttgtcacccaggctgcagtgcagtggtatcatcatagctcactgcagtcttgaacttctgggctcaagtgattgtcccgtctcagcctcctgagtagctgtaagtacaggcatgtgctaccatgcctggctactttttttctttttttctgtacagatggcaccttgctatgttgccccagctggtcttgaactcctgacctcaagtgatcctcctgccttggcctctcaaagtgctgggattacagacatgaggcaccacatccagccccataatcttaaaaacaaagaaaattaatagttttccattttagactcaaactctggaccagacagcactgatcttgactatctgaggtgatagaaatagcctttatctgtgttatttgatttgatagctactagccacatgtggtttctgaacacacttgaaatgtaactagctagttgcaactgagggaactaggttttaaatctcattaaattttaattaagttaaagtagtctcctgtggccagtggcttctacattaggcaatgcagctctaagcaagatgaaagagagaatgccaatattatctacatttaacaacataaaagtaaatgtacaggtaacagaaatgagcagaagagagataaaggaaagccactatcttcatgtcacaaagtgataagaatttaggccagaagctgtggctcatgcctgtaatctcagtacttttggaggccgaggcaaggaggatcgcttgagcccaggaattcaagaccagcctgggcaacataatgagatccctgtctctacaaaaaaaattaaaaattagctgggcatgatggtgcacacctgtagtcccagctactcaggaggctgaggtaggattgcttgggcccaggagttcgagggtgctcatctctttaaaaataagtaaataggtcaggtgaggtggctcatgcctataatcccagcactttgagaggctaaggtggacggattgcttgagcccaggaaattgatctcagcctgggcaacagcgaaacaatgtctctacaataaatataaaaagtaaccaggtgcatgccgggcgcggtggctcacgcctataatcccagcactttgggaggccaaggcagggtggatcacaaggtcaggagatcgagaccatcctggcgaacacggtgaaaccctgtctctactaaaaatacaaaaaattagccgggcatggtggcgggtgcttgtagtcccagctactcgggaggctgaggcaggagaatggcgtgaacctgggaggcggagcttgcagtgagccgagatcgcgccactgcactccagcctgggtgacagagcgagactccgtctcaaaaaaaaaaaagtaaccaggtgcggtggcacacacctgtagttccagctacttggaggctgaggtgggaggatcactggagcccaaggttgcagtaagctgagatcaggccactgcactctagcctgggcgaaagagtgagaccctgtctcaaaacaaaacaacaacaataataaaactcatacataactacgtaaataaagttacaaaagcaactttagttcgttacaaaggacctgaagagagggatttaactgacctgcaaggtggaatggggctggagcagggccagtgggtcagacacctatgattatgccaggcaaaatggatacatgaagaaataaagttatagcatctccatgtagtaatagaaaaaaaaaaggaataacgaaattagcacactttttgggaatgtggacccaccagtagaattgagactagaaaaagttaaaagcattagaagtgttctctttctgagatcatgacttgttggggaaagggaagacttattgttcatgacaaacacttctgtgcttataacatgcattagcttaggaaacagcacttttctttttctctttttttttttttttttttttttttgagacaaggtcttgctctgtcgcccaggctggaatgcatgttgcgatctcggctcactgcaacctctgcctcctgggctcaagcgatccttccaccttggcctcccaaggcgctgggcgctgggattacaggcatgggccaccgtgcccggcctggtgcttttcagtgaataaataagtatgtaaacttctcttttctgactagacggaaattccccagaggacaagggtggcgtgacttgtcagtccttttcattgacagcgctgtggatgggaagaaagggcccctggtcccaagcaagccccagtcctgtggccctggaggatcagaagggtaattaagtgtcaaaggaaaacatagccagacatgagttactgtggtgaaaacagattttattcagtaactactcgtggtaggagaaagagctgagctccattctgatttgtgcagaggtgatttaggcatttaattagttaattagtttttgtgggacagggtctcgatctgttgcccaggcttgtgattgtgcctgttgctcagattgtgcagtggcacaatcatggctcactgcagcctcgaactcccaggctcaagtgatcctcctacctcagcctcctgagttagctgggacccacaggcgtatgccactgcacctggcttttttttttttttttttttttttttgaaacagagtctcgctctgttgcccaggctggaatgcagtggcatgatcttggctcactgcaaccaccacctcctgggttcaagcaattctcctgcctcggtctcctaagtagctgggattacaggcgcgtgccacaatacccagctagttttagtttgttttttatttatttattttttttagtagaaacgacgtttcaccatgttggccaggctggtctcgaactcctgacctcaggtgatccacccacctcggcctcccaaaatgctgggattacaggagtgagccaccgcaccagtgtctctctcttataacaccagctagtccttatcaggctttgactgtgggcccctcacctgtctaacttatccttcccaggaactttgaagaatactattattattcctattttgcaaatgaagaaactgaggcagattaaatgcctgacccaaggccatccagacggcaggcgatgcaggcaggagtcaagctcaggtacccctccccttctgtggcttccctgcctccaggcttctgccagcccctgtctaccttggtgtaggagcggcccctcaaagacctgcagggagccgggcacggtggcgcacgcctataatctcagcactttgggaggctgaggtgggcgtatcatgaaaccctgtctctactaaaaatacagaaattagccgggtgtagtggtgggcacctatgatcccagctactcagaaggctgaggcaggaggaacgcttgagaaccccagaggcggaggttgcagtgagccaagatcgagccactgcactccagcctggacgacagagcgagactccatctcaaaaaaaaaaaaaacctgtagagggaaggaggaactggggcctggggagggcagagctattatctcaggagaagcaggcaaacctctggtgacctctgatgacctcagggcaggatgggcaggccttcacaacagctccaggcacacccagcctcccgtccctggcctcatcactcccctctctgccctccaccctttggcctccttgcctttgtccacagttctgcagcctgataccctcttccttgtctcaaccagagaagtcttcagtcaataaacgtcatccaatgcctactgtgtgtcaagcacttcctgggtgctggggcactgtgcaagcacacacgcacagctgtgaggccatggggctggcattccagtgtggggagagcgacggaagcaaaataagaaagtccattacatggcgcatttgaaggcgcgaagtgctatggggagaaagcaaggaggggggttacagtccagagggaggggggtgcgattttttttttttttccagacggagtcttgctctgtcacccaggctggagtgcagtggcgtgatcttgcaaactccgccgcctgggttcacgccattcttctgcctcagcctcctgagtagctgggactgcaggcacccgccaccatgtccggctaattttttgtatttttagtatagacagggtttcaccgtgttagccaggatggtcttgatctcctgaccttgtgatccacctgcctcagcctcccaaagtgctgggattacaggcatgagccaccgcgcccacccgggggtgagattttaaatacaatggccagctgggctccgtggcacacacctgtaattccagcactttgggagaccgaggtgggaggctcacttgagtctaggagtttgaaacaagcctgggcaacaaagcaagatcccatctgtatgaaaaatttaaaaattaggccgggcatggtggctcatacctgtaatcccagcactttgggaggccgaggagggcagatcacttgagctcaggagtccgagaccagcctggccaacatggtgaaacactgtctctactaaaaatacaaaaaaattgctgggcgtggtggctcacgcttgtaatcccagcactttgggaggccgaggcaggtggatcacctgaggtcaggagttcaagaccagtctggccaacatggtgaaaccctgtctctactaaaaatagaaaattagatgggcttggtggtgggcacctgtattcccagctactcaggaggctgaggcaggagaatagcttaaatccaggaggcggaggttgccgtgagccgagatcgaaccattgtgctccagcctgggcaacgagagtgtgaaactccatctcaaaaataaaaataaaaatacaaaaaattagccgggcatggtggcgcgcacctgtaatcccagctactcgggagactgaggcgggagaattgctggaactcgggaggcggagttgcagtgaaccaagattgtgccactgcactccagcctgggagacagagcgagactccatctcaaaaaataaaaaattaaaattaaaagttagactggtgtggtggcatgtgcctgtagtcccagctacttgggaggccaaggcgggaggatctcttgagcccaggaggtcgaggctgcagtgagccatgattgtgccaatgcactcaagcctgggtgacagagtgagaccctgtgtctaaaacaaacaaataagtaagtaaataggttggccaggcaaagccatcctgagaaggtgacatttgagcaaagactgagaaagcagccaagcaacatctgggtggggagccctggggcagccaccacagatggcgcaaaggccctgggcttgctttctccagggacacatcagaggtccgggtggcaagggcgtggatggcagggccatgggtggaagggcagaagcaacgtggataagagaggtaggcaggggtcagatcggatgtggccaacttggcttctaccctgagtggggtgggagtggtctcagggctccaagcagaggaggggtggggtcagatgtttcatctgggtccctctggctgctgtgtggaaaacagcccggaggaggatgagatctcacacagggagaccagagctgagatgactgcaccagtccaggccagagaagacagaggctcaggccagtaggcagcagtgacggggcgaagagggatcagattctggatctttctctctctctctctctcttttttttttttttttttttttttttttttacagacaaggtatcactgtgttacccagggtggagtacagtggcgaaatcatagctcactgcagccttgaactcctgaactcaagcgatcccttctcctgagtctcccaaagtcctgggattacaggagtgagccactgtgcccagggcaggttatacattttttttgggaacaccacagaagccaagcacagtggctcatgcctgtaatcccaggacttctggaggcgaagatgagaggattgcttgagcccaggagttcaagaccagtctgggcaacacagcaagaacccatctctaaaaaaaaaggaatactgctgggcacggtggctcatgcctgtaattccagcactttgggaggctgaggtgggtggatcacctgagattaggagtacgagaccagcctggctaacatggcgaaaccccatccctaataaaaatacaaaaattagctgggcatggtggcagggacctgtaatcccagctattcaggaggctgaggcaggagaattgcttgaacccaggaggcggaggttgcagtgagccgagatcacatcactgcactccagccagggtgaccatgcccagccaactatgtaaatatcctatacacacacactcttctgatttcaccaatggttttaacactcactcttacctgaatccattattattatattggttatgtttatcattttttaaattctacattccttttacaattgttagctttcctacagtaaaataactttccagtggccgggcacagtggctcatgcctgtaatcccagcactttgggaggccgaggcaggtgaatcacgaggtcaggagttcgagatcagcctggccaacatggtgaaaccacatctctactaataatgcaaaaattagccaaacgtggtggtgcgcacctgtaatcctagctacctgggaggctgagggaggagagttgcttgaaactaagaggcggaggttgcagtgagccgagattgcatcactgcactccagcctgagcgacagagcaagactacatctcagaaaaaataaaacaaaaacaaaaaaaacttccatactgtcctacctcccttccctgctccctccctccttctctttgtctctaatattttcagaatcagtatgaactcattttcttttcttttttttttttttccaagacaaattctcactcttttgccgaggctggagtgcagtggcatgatctcagctcattgcaacctctgcctcccaggttcaagcgattctcctgcctcagcctcccgagtagctgggactaccggcgcccatcaccacacctggctaattttttggtaatttttagtagaaacggagtttcaccatgttggtcaggctggtctcgaactcctgacctcaggtgatcctcccgtctcggcctcccaaagtgctgggattacaggcatgagccactgcgcccagcctctttttttcttttaattaaaacaattaaatagagatggggttctctgtctgttgcccaggttggtcttcaactcctgggctcaagcaatcctcctgtctcgggctcccgaagtgctgggattacaggagtgagtcaccacgcccagcctaagtattgctcttctgtgatgatttgcaggcaacaatcacctcttgttcatattttcattatctttccctccaccccgagcctatagtctgtcttggtcagaccccatttcttgagtgcaccaggctggagtttggacccatccacatcctcgcagctctcctgagttggggcccaacatctggcttggggaacagacagctttgccgacagcagtaacaatttggttgaaatgataactttgtcaaaaatgaattttgccttagtgtttttttaaaggttgagaatcttgtacattcttacaacatttctattttctacagttaaaaaactgtaggctgggtgcagtgactcactcctgtaatcccagcactttgggaggccaaggtgggtggattgcttgagtccaagggttcgagaccagctaggcaacatagcaaaatattagctaggtgtggtagctactcgggaggttgaggcaggagaattgcttgaacccaggaggcagaggttgcagtgagccaagatcatgccactgcactccagcctgggcaagagagctagattgtctcaaaaaaaaaaaaaagtaagttccaattactttgcagccaattattcttgctcttctatttgcaatagcagaagattgaaatagcctcctagatgtctgacagtggaatgggttcttttctttttcttttttggtagagatgagggtctcactatgtggccaggcaagccttgaactcctggcctcaagtgatcctcccgcctctggaggcaggaggtagggtacagtcccagactcaaagcactgggattacaggagtgaaccactgcgtgagcctggtttcttttctttcccctccctcccttccttccttccttccttccatccgtccttccttccttccctccttctctcctctttcactctacctctttcttttcttcttttttctggcttgttaaaacagaaatacataataattatagtgaaataaactagggtatttactgcagcagttagtaataatgaaatgttggaaaacaatctaatgttcatccgtagggaatatttaaaatatagtgtatttctgccgggcgcggtggctcacgcctgtaatcccagcactttgggaggccgaggcaggtggatcatgaggtcaggagatcgagaccacggtgaaaccctgtctctactaaaaatacaaaaaagttagccgggcttcgtggcgggcgcctgtagtcccagctactcgggaggctgaggcaggagaatggcttgaacccgggaggcggagcttgcagtgagcagaaatcgcgccactgcactccagcctgggcgacactgtgagactccatctcaaaaaaataaattaattaaaaataaataaataaataaaatatagtgtatttctggccgggcgcggtggctcactcatgtaatcccggcactttgggatgctgaggctggcagatcacaagatcaggagatcaagaccatcctggctaacgcggtgaaaccctgtctctattaaaaatacagaaattagctgggcatagtggcatgtgcctgtagtcccagctacttgtgaggctgagacaggagaatcgcttgaacctgggaggtggaggttgcagtgagctgagatcgagacactacgctccagcctgggtgacagagcaagactccgtctcaaaaaaaaaaaaaattatagtgtatgccatggaatattatgcaactgttatatatgtgtgtgtgttcccaaagcattgttcagtaacaaaggaaaagtgcaaaacactaaaatggatgaatacatgcttgtgtaaacacagacactgtcaggaatgtttgtctggaggtgatgggtatggagcctttttgtctgatatattgggtgtatcaagaatgccaggtcctgagcagttttttttttttttttttgagttggagtctcactctgttgcccaggctggagtgcagtggcacaatctctgctcactgcaacctccacctcctgggttgaagcgattctcgtgcctcagcctcccgagtagctgggattgtaggcgcccgccaccatgcccagctaattttttgtgtttttagtagagacggggtttcaccatgttggccaagctggtctcgaactcctgacctcaggtgatctgcctgcctcggccttccaaagtgctgggcttacaggcatgggccaccgtgcccagccgtttatatgtattaactcttaatcatcaaaacaaactatgtggtattaccataattatcgccatttatacaaagcaacagagggataaggagattaaggcacttgcccaagtgcaagaggtaggacaggaacccagagtcccgtgctggtagctgcttttctgtgcacttaacattatctcatttaattcttgcagtcacttcatgaagaaggtggcggtcctagggcattggagaagttatgtgcttgttcaaggtcatgcagctggaagatggtggtggtaggacaggaagtctgtagggcctgattctgcagccctctagtctatactcctttgctcctgtgtccctcatcccccctgcagaatgggcaccccgttacctttctgagccactgtgcgcagaaaagagagcatgttggccaggctggtctcgaactcctgacctcaagtgatcagcctgccttagcctcccaaagtcctgggattacaggcgtgaaccaccacgctcagcctctgaatactttgtactcaagccatttttcagtgctgtgtttgcagtgagcacacccgagggatgaagacacgtctccctgtgggaacctgggcttaccagggcccctagaggaggggaatctctcaagctcagagctctatggctgcggtgcaggcccactgtgtgcatggtgtcagtctgggcccttccatgttgcccccgtgggacttggggtaaggggaactgatgcaaacatcacgctgctgttgcttggtgtgagcaattaattcctgtggctctcacccaggagtctcatgtctttgggtcagacaaactcatcagcttgtagaaatggcacagtcccacgggcctgttagaatcttctattgtgcacatgttgctcttaaaatatacaaatcagttttgattttaaaaaattatttatttttttagtgataggagttttgctacgttgcccaggctggtttcaaactcttgggctcaggaggtcctcccactttggcctggactgccagcataatgtatcaccacacccgggactgattttcgtttttcaagaacaaaaaccaaaaacatacacaaaccgagagtcaaagcttgctaattagaggaaagtcaggaaatgggaaccattcaaagaagaaaatacccccacctcctactctcacctatccaaagacaattaggtgaatcccttagtagatatctttccagacggttttccatatagattcccatatctggccaggcgcggtggctcacacctgtaatcctagcgcttggggaggctgaggcggatggaccacctgaggtcaggagttcgagaccagcctgaccaacatggagaaacctcgtctctacgaaaaatacaaaattagccgggcacagtggtgcaagcctgtaatcccagctactcaggaggccgaggcaggagaattgcttgaacctaggaggcagacattgtgctgagccgagccaagatcatgccattgcactaaactccgccttaaaaaaaaaaaaaaagattcccacatctttactagtttgcagaaataagatcctagcatatgcagtgtgtaggaaccaccttggtttagccacgtctctgtgactgggggccactgtggtgacccccagctccccggacagagtcaagagctcaccagcctgcaaaggttttcacggcccccagccagactcgggggcttcctcttgccctgctacttcctgggagctctgagggcaggaaatggcgccactcagctcctggcctaacagcttggggaccacaaatgcaaaggaaaccaccctcccctcccacctcctcctctgcacccttgagttctcaggctcacattcccaccacccacctctgagcccagccctccctagcatcaccacttccatcccattcctcagccaagagccaggaatcctgattccagatcccacgcttccctgcctccctcaggtgagccccagacccccaggcaccccgctggcccctgaaggagcaggtgatggtgctgtcttcgcccagcagctgtgggagcaggcgggtggggcaggatggaggggtgggtggggtgggtggagccagggcccacttcctttccccttggggccctgtccttcccagtcttgccccagcctcgggaggtggtggagtgacctggccccagtgctgcgtccttatcagccgagccggtaagagggtgagacttggtggggtaggggcctcagtgggcctgggaatgtgcctgtggcttgaaaagactctgacaggttatgatgggaagagattgggagccattgggctgcacagggtcagggaaggccaggaggggctggtcactgctggaatctaagctgctgaggctggagggagcctcaggatggggctgatgggggagctgccagcatctgttcctctgtcatttctgataacagtaaaagccagcatggaaaaaaccgttaaaccgcaggttgggcctggccgttggcagggaagtgggcagaggggaggcccggccaggtcctccggcaactcccgcgtgttctgcttctccggctgcccacctgcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctctctctcacacacacacacacacacacacacacacgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctcaaaaaataaaaataaataaaataaataaaagagaggcacaaacagtgttatgaatgcaccaaggaaaatggtgcattcataactctcaggtgaagcctaccaagccatgcgtgtgtgcacatatgtgtgtacgtgtgcatgtgcgtgcgtgcatgtgcgtgcgtgcatgtgcctgtgtgtgtatgtgtgcacatgtgtgtgcgcatgtgtgtgtgtgcgcgcatgtgtgtgtgcatgcatgttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaatttttttttttaatttttaatttgtacagacagggtcttgctgtgttgcccaggctggtctcaaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgagtctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttggaaaaaaatttaaaaaaagaaaatataaaatatggtataagattaaatatattagttatgaaaataattgtaaatggcttattgaacttatagtcagtaaaaatcatgtttttgaaaattatgtaatgactttggaaaataccagcaatataatgttaagtggggaaaaaagcaagttactcctctgtaatacatatgattttagttttgtaataaaaattcccaaccatatatgcacttatagggaaacaaaggacccatcgcaaatgttttccatgctgatctccaaagtggtgagtttatgtgtgatttttattttgtttatgctcttctgtattttccgaatttcatacaataaatatctgttacttttacaatatgaaaaaatagtggtcaaaaaggtgttcaagggggtggcctgggggtgtctggtttgaggagagtggtaggggatgaggctgcaagtggaggttggagccatgctatgaaaagttcaagagtttgaattgagttctgaggtttgtttttgtttttgtttttgttttttgagacggagtctcaccctgtcacccaggctggagtgcagtggcacgggttcatgccattctcctgcctcagcctcctgagtagctggaaccacacgcgcccgccaccacaccaggctaatttttttgtatttttaggagagacagggtttcaccatgttagccaggatggtctcgatctcctgacctcgtgatccacctgcctcggcctcccaaagtgctgggattacaggcgtgagccacagtgctctgcgtgagccatagtgctctgctgagagtttgaattgcattctggaagtagtggtgaaatcaacacacctaagtctgctcttctcctctcttctagtccccagagtggtgagtagcatcgttctggtggcccaggcaaaacgccttaggaccaccgtgcagccccactctttccccattcctgctctccaggtgccaagtccctggctcttcttccaccgacccttgcatcccttccttctcttcagtcctcatcgcacctcaccgggatcctattgacacttcccctttgatttccttccgctctctgctagtgatggtcccagggacccttctaaaaggtcactgtgggctgggcacagtggctcacgcctgtaatcccaacactttgagaggctgaggtgggccaatcatctgaggtcaggagttcgagaccagcctggccaacatggtgaaaccccatctctactgaaagtacaaaaattagccgggcgtggtggtgtgcacctgtagtcccagctactcgggaggctgaggcgggggaattgttggtccccgggagatggaggttgcagtgagccaagatcgcgccgttgcactccagcctgggtgacagaatgagactccgtctcaaaaaaaaaaaaaaaagaaaaaagaaaaatagctgggcatcgtggcacacacctgtagttccagctactcaggaggatgaggtaggaagatcacttgagcccaagaggtccagactgcagcgagtcatgatcacaccactgcactccagcctgcgtggcaccctgtctcaaaatataataataataaaatttaaaaataaaataaaacgctgctctgtctaggtgatattcctctatccccaaggctgtcagggtggaaccctccttccttagcgtggcatataagcccctcgggacctggccctatctctcctctgaccacccctgcccggtcagcccttgttacagacagtctgtgctatccagccccatcaaattcctgttgctccctaaatatgccacacactttatttggaggagaggggtgaagaagggtagtttaacatgttcaaaatatttattttttccagacagtaaaataacattttttcctgttttgcaaaagttaattatcagcacattgaagattttccttttttttcttttctttttttttttttttttgagtcaaagtcttgctctgttccccaggctagagtgcagtagcgcgatctcggctccacctcccgggttcaagtgattatcctgtttcagcctcccgagtagctgggactacaagcacatgccaccatgcccagctaatttttgtatttttggtagagacggggtttcacaatgttggccaggctggtcttgaactcctgacctcaggtgattcacccgcctcaccctcccaaagtgttgggattacaggcatgagccactgcgcccggccagcagtcttaaataacagaattcacacacacacacacacacacacacacacacacacacacgcactgtattatatttcatcttatactttaaaatgtttccttttttttcctcaaaagtacacattaagatcatgtttacaaataaagccttgtcatccaaagtgaaaaatccagatggcaagatttggatggggaaggtcttgagaaatctgcgaatggagttcacttttgcagacaggaaatgggccctaatatatggttctaaggacattccatttctgaaaatgtacatttccacccgcttttcctctccttccttcctccctccctccctccctctctctctctctctctctctttctttctttctgacaaggtcttcctctgtcgctgacgctggagtgcaatggtgcgatctcggcccattgcaacctccgcctcctgggctcaagtgatcctcccccctcagcctcccaagtagctgggaccacaggcacacgccacggcacccagctaatttttgtattttttgtacagatgggttctcaccatgttgcctaggctgatcttgaactgctgggctcaagtgatcctcccgcctcagcctctcaaaagtgctgggattacaggcgtgagccaccgcacctggcctgcatccccatttctgacccttgaccatgttcaagtgggaaggggaagccggggaagggaggacgggctacctgagggctgcgggtagaggtgactcctgtgagctgtgagccctcagcccttgggcagagggaacagaacagaaacagaccccatctctgagccaccaagctcagactcgtgtggcaggagacagatcacacaacactatcaacaaaacaacacaggtcgcagtggctcacacctgtaatcccagcactttgggaagctgaggtgagaggattgcttaaccgcaggagttcgagaccagtctggccaacatagcgagaccccatctctcaaaaaaagaaaaaaattagctgggcctggtgatgcacacctgtagtcccagctacttgggaggctgaggtgggaggacagcttgaaccagagaggtcgaggctgcagtgagctatgattgtgccactgccactgcactctagtctgagcaatagagtgagaccctgtcttccaaaaaaaaaaaaaaaagagagagagagagagaagaatataatcaaaagtttctaaattcccaaagtagtaacaaaagcagacccaaacaaaagtagagagaaaatcttcgaaacttaaaaggctatttaggctaaggagcccacccagtggtgaccacctagttctgggaggtttggggcagggccattagacaatggaaactcaggttattttggagacaatcaacttgctcccaaaaatgagctgcaagcaggtgcctgtgtgctcagcccagtctggagctcagagcctgcctgccccactgcaccatcaccagcccagctgaaccagggtcccaggcaagccgtacaggctctgcgttggccttggagagaaccgccgactcccccgagttgcctgagctcggcctgaagccagccctccccacgctggctcacaataaatgccttgacttcccgccaactcttcctcaaccattaagattcagctcaactgtcacgggctctgtgcagctgccctcgctgccccaccccacgcagactttgtgttccttctccactcctgcagcaccccttgcgacagcatgaataacccggctgtagtgatgtgagggtgacactcatcaccagtgtgtgagcccctccaaggccacatgtcctctttgtgtttccagagcccagggcccagcatgcggtagctacctagtatatgtttactgaatggagggatgaataaattcatgcacaaagaatagttttatttatttatttatttttgagacagagtcttgcttctgacacccaggctgtagcgcagtggtgcgatcttggctcattgcaacctctgcctcccaggttcaagcaattctcctgtctcagcctcccaagtagctgggattacaggcatgcgcgccaccacgcccggctaattttctatttttagtagagacgaggtttcaacatgttggccaggctggtctcgaactcgcgacctcaggtgatctgcctgccttggtcttccaaagtgctgggattacaggtatgagccaccgcgcctggccttatttgtttattttcataaacaaatttctgttgcccaggctggtctcaaactcctggcctcaagtgatcctcctgcctcagcctcccaaactgttgggattacaggcacaagccacagtgcctggcccagttctgtcctttgagttgacctggtcatccaggaggatgttctgaggaagtgtgaaatgataatattattctagcccacgctggatacagtggcagtctggaaggtgaaagaggttgggtttgaaatagatttattggccaagtgcagtggctcacacctgtaatcccagcactttgggaggccgaggcaggagaattgcttcagcctttaaacatggcgaaaccctgtccctattaaaaataaaaaagttcgatgggcgtggtggcattcacctgtagtcccagctactcaggagggtgaggcaggagaatcacttcagccctataggttgaggctgctttgtgctgtgatcatgccaatgcacgctagcctgggtgacacagtgagaccctgtttcaaaaacaaaaacaaaaacagaatagaggcctggagcttgagagggaactcaggatagaagatatagatttaagagtcggctggatgcagtggctcaaggctgtaatcccagcactttgggaggctagggtgggtgtatcacttgaggtcaggagttcgagaccagcctgaacaacatggcgaaaccccatctctaccaaaaataacaaaaactagctgggcatggtggcatgcgcctgtaatcccagctacttgggaggctaaggcaggagaatcacttgaacccgggaggtggaggttgcagttagccgagattgtaccactggattccagcctgggtgacagagtgagactccctctcaaaaaataaaaataaaaataaataaataaataaataaataaatagtgatacagatagatagatacataaattatatcattcactgggtagattgagaagagagctgtagagagaatctgagtgtaatagtcagggcaggctaactgctgtaagaaacagtgcccccacatctcagcggtataactcaaaagaagttttttccttcttatgacagtcaattcctgacatctggagcatgacctttcacaacattattccgggacccagtctccttccatctagtggctctgtcatcctcctagggccttggagtggtctgcttttgaccagctaatgggaggggagaggcagaataggatcctgtgaagacttctagggtcaggtctggaaatatcttttgctcacactccattggccagaacaagactgcctcagtgcagaggaagctgggaaatgtagtttagtagggtacccagaaggaaaagggaaacagtctctgccacactgaagcaacaccaaaatctgagggttggatgtaggaagaagcacctgcaaaagatagaaaagagcctttaagaggatcacctgaagccaggagtttgagaccagcctgggcagcatagcaagatcctatctgtacaaaaaataaaaataaaaaattagcctagggtggaggcatgcacatacagtcccagcaactcaggaggcttggggccaggagtttgaggctgcagtgagctttgattgggccactgcactccacttaagcctgagtgacagagcaaaaccctgtatccaaaaaaaaaaaaattaaccaggagaaaaatgacatttggagatcctgtctctaaagaaaaaaaaagctcactgcatagctcactgcagcctcagaaacaggcccaggactgaatcaaggccagcaaggtgctggggtgataagcgagcccgactccagcctggccaacacggtgaaaccccttctctactaaaaatacacaaattagctgggcatggtggcagacgcctgtggttccagctactcaggaggctgaggtaggaggatcacttgagcctggggcgtggaggttgtagtgggccaagattgtgccactgcactccagcctgggtgacagagcaagaccctgtctcaaaaaaaaaaaaaaaaaaaaaagtgagctggaggatgaggcctccctaaattttgtgccttgggtgtctcgatccgtcacgccagccccagtcccggcagtcaggtgcggcagagaaagcaaagggagaaggctgggaagatgcaagtgaatttagcgactagcagtccctgtgagcaactgtagcaagaagggtttccaatgaagaaaggaaggccctgggccaggcgcggtggctcatgcctgtaatcccagctctttgggaggcagaggcgggtggatcacctgaggtcgggagctcaagactagcctgaccaacatagagaaaccccgtctctactgaaaaaaaatacaaaattagccgggtgtggtggcgcatgcctgtaatcccagctattcgggaggctgaggcaggagaatcgcttgaccccgggaagcggaggttgcagtgagtcgagatcacgccattgcgctccagcctcggcaacaagagcgaaactccatcaaaaaaaaaaaaaaaaggaagaaagaaaggccctggcagttcttggacaggaacttgcctgaagtcccagtcccggtgactggtggtttccccactttctggttcagaagctgggctctaagctgtctgtgcccttaaagttccttggaaagagggaagggaagggaagtggatattaggtgagttcctactctgtttcatttgcagagttttctcattgattctcagttggacccatgaggtagatgttatgccattacattttttttttctttagagacagggtctctctctgtcactcaggctggactgcagtggcacgatcacggctcactgcagctttgaactcctgggctcaagtgatcctcccatctcagcctacaggtgtgcaccactgtacttagctaatttctttttcttttttctttttttgggagagatgggatctctgtatgtctctatgatgcccacactggtctcaaactcctggcctcaagcgattctcctgccttggcctcccaaagcacagggattacaggcatgagtcgctgtgcccagcctgttatgccgggtttttttgttttgttttgttttttgagacagagtctcgctctgtcgcccaggagtacagtggcatgatcttggctcactgcaagctccacctcccgggttcacaccattctcctgcctcagcctcccgagtagctgggactacaggcgcccaccaccacacccggctaattttttggttttttagtagagacggggtttcaccatgttagctgggatggtctcgatctcctgacctcgtgatctgcctgcctcagcctcccaaagtgctgggattacagtcgtgaaccactgcatccggcctgttatgccgttttttaaattaattaataaatttatttatttatcttgagacagagtctcactctgtcacccaggctggagtgcagtggcatgatctcgactcactgcaacctccacctccggggttcaagtgagtctcatgcctcagcctcctgagcagctgggattacaggcggccgccaccatgcccggctaatttttgtatttttagtagagatggggtttcgccatgttggccaggctggtctcaaactcctgacctcaggtgatcaacctgcctctgcctcccaaagtgctgggattacaggcgtgagctcctgtgcccggccctgttatgccattttaaagctaaggaaactgaggcacagaaaaaggtaaaaaggtacttgagatcaaaaaggatggagttaggatttgaacccaggtccagggcccatgattttcccagcacaccatccaaaatgcctgcctgccctcaccagggagcacatgcttacattcacagccttggaccctgggttagggccaggagggctgggtgttgggtgagaacagggcctcgggctccttcactggctggggcagggcttctgagttccccatcagagcccctcctctgactttcagggcctgctgaggaatctgcaggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggtaaagggacactctctctgccatgtccctgcacccatccccccactgcctacccctgcccccaccctggcttgtctcagccccttgttgcctcctctggagtcatctctcctctggtcccgccatcgactcccttacctaccccatgtccctgcagccttgctcaacccccagaggccccttctcactcttctttctcctgtgttgagtccccaaggagctctggggaaggaaggggcttaagccctagaaaagggcagggtggcctggaggaggtggcgtctcctgggggcagtgggggccggaagtgggaggctggttgggggagcagcatggacttctgctctcgctggtagctcgggagaagcagagacaaagtcctgtcccttctgcagctgggtgggggagggggcttgagtcccgtgattccctgcctggagggagctgtatgcaaactgttggggtgatcagtcccaacccccaaccatgaagtccggtggcaacaaaggaatgagaaaagacaagttaagatttaaagcagccccagggggccagttgctaaagtgaaggctgcagagccctggttgcctgataatttattgagtacaatcttttgatctaagaagcagatggtacggggtgaaacggtgaaggtgggggtgtgcgcgtcatttgaaagatgtatagccgtggtggtttatgtgaatttcctttaagctcaaagcatatgtctaactactaagataatcttttttttttttttttttgagacggagtctcgctttcccccaggctggagtgcagtggcgtgatctcggctcactgcaagctccgcctcccgggttcatgccattctcctgcctcagcctcccgagtagctgggactacaggcgcccgccgccacgcctggctaattttttgtatttttagtagagacggggtttcaccatgttagccaggatggtctcatttcccaacctcgtgatccgcccgtctctgcctcccaaagtgctgggattacaggtgttagccaccgtgcccggccaactaagataatctttaacttattgggctgcagctggtgggagtgggttttacaaggagccaggatgtctggtcacattccaacgcttcaaggaagtgtttcagcccagagcattctgtgtaaagccgcagagcaggtcatgttcactggcctggggacacaatggcaataaggaggtgattctcctcagaggccccctatggtgttccataggtgtcctacacaggggtggctgactaaactggcgccccgtaaacccttccaccagcacaaacccaggggtccatgctctacgctcagaaggctccaccagggatggggctgtgtgaccatgggtgggtcctggcttctcagagtcccgttttcttccatctgtaaaatgacaataatagttccctgctctggcccgccacggtggctcacgcctgtaatcccagcactttgggaggctgaggtgggtggagcacttgaggtcaggtgtttgagaccagcctggccaacatggtgaaaccccgtctctactaaaagtacaaaaattagccgagtgtggtggtgcgcacctgtaatcccagctacatgggaggctgaggcaggagaattgcttgaaccccagtggcggaggttgcagtgagctgagaccaggcctcagcactccagcctgggcgacagagcgagactccatctcaaaaaaaaaggaaaataaatagttccctgctcagaaggttgtggggaggacagaggatgggaggcacaggtgcttagaccctcctccatgtttgaggtgcctgctggccccatacacccggtccctctggctccactgtggaaccagctctcaggggtcccatgcaggatgccacgccaaacacctttcaatctccattgtgtctttctcttttgaaacaacgccgacctggatgtgaatcctgactgccactcagcagcagtggaaaccctggcaagttttgtaacctgtagaagcccgtttccacatctggacaatggagttggtggcactggtctcacggggttgtaatgaagattaaataccttagcagatgtcaaggggtctcgacctgattccttcagagccaggattctttactgagggatcagggatgggctctgggggagttcatgaaccccagaatttgcaggtgaaattgtgtgtctttgtgagaacacggttacgcatttttctgggaaggagatccataattttcatcagatccagattctttttttttttttttttttttgagacagagtctcgccctgttgtccaggctggagtgcagtggcatgatcttggctcgctgcaacctctgcctcccgggttcaagcgattctcctgcctcagcctcacgagtagctgggactacaggcataaaccaccatgcccggctaatttttgtatttttagtagagatggggtgtcaccatgttggccaggctagcagatccagattctttttttttttttttcgagatggagtctgactctgtcaccaggctggagtgcagtggcaggatctcggctcactgcaaccttcacctcccaggttcaagtgattatcttgcctcagcctcacgagtagctgggactacacgtgcttcaggcacttgctgccatgtccagctaattttgtagttttagtagagacagggtttcaccatgttggccaggatggtctcgatctcttgaccttgtgatctgcctcctcggcctcccaaagtgctgggattacaggtgtgagccaccgcacccggcctcttttgttttttagacggggtcttgttctgtcacccaggctggttggtgtgcagtaacataatcatagctcactgtttgtagcctccaacttctgggctcaagtggtcctcctgcctcagcctgtggagtagctgggactgcaggcgtgtgccaccacacctggctaattaaaataaattttttttttttttagagatgggttcttgctgtgttgcccaggctggtctcaaactcccagcctcaagcgatcctccaacctcagcctcccaaaagtgttgggattacaggcatgagccaccgtgcctggctcaaatcttttcatatgtgaacatctcagcatgttttctttctttcttttttgagatggagtttcgctcttgttgcccagactggagtataatggcgtgatcttggctcactgcaacctctgcctcccaggttcaagtgattctcctgcctcactctcccaagtagctggggatacaggtgcccaccaccatgcccagctaatttttttgcatttttttttttagtagagatgggttttgccgtgctggccaggctggtcttgaactcctcacctcaggtgatccacccaccttggcctcccaaagtgctgggattacaggcgcaagtcactgcgcccagcctcatcatgtttttttcttaaaagataaagacttttctttttactacaaccacaatactattgtcaaaactaaactttaaaaatttccttggtgttatcaaacattcaatgtccagattccagtggtttcataaatagcctaatttgcttttagtttgtttgaattaggatctaagtaaaatctacactttgtgattggttagtatgttttaagagtctttgaaactttatttttttgattaaaaaatgtttaatttagagataggggtctcactatattgcacaggctggtctcaaatgccccaaagtgctgggattacaggtatgagccaccacacctgactgattctttttttttttttttgagatggaatctcactctgttgcccaggctggagtgcagtggcgcaacctcggctcactgcaacctccgcctcccagattcaagcgattctctcaccccagtctcccgagtagctgggattacaggcgtgcaccaccacacatggataaattttgtatttttttagtagagacagcgcttcaccatgttgtccaggctggtctcgaactcctgacctaaggtgatcttaggcccaccttggcctcccaaagtgctgggattacaggtgtgaccaccacgcccagccaatatgtggtcttatgagagcattggttcttttttttttttccctgaggcagggtctcaccctgttgcctaggccagagtgcagtagctccatcatagctcactgcagcctccaactcctggactcaagggatcctcccacttcagccttctgaatagctaggactacaggcgtgtgtcaccatgcccagctaatttttaaaattgtttttgtagagatgggttctcactatgctgcccaggctggtctcaaactcctggcctcaagcgatccttctgcctcggcctcccaaagtgttgggattacaggcatgagccaccgcccctggccgagcattgattcttgatcctcatgtgcatctgagtcacagagcagggtgggggctggctcttccccaacctggatccctggaaactacccccagagattctggttcactgggttggaatgggcctgagcatctgaaagtttgaaaagctccctgtgattctggtgtgcagcccaggcagaggccccactgtgtccacttctcttgaaaggagtggttcacaccaacacccccacttccctacctcccgtgcgctcctcgagcatgacaatgtggcttctgcccccgacacatggcacaaaaaccgctctggcacaggcctcacagttgctaagtgcagagccccatcctcagtcttccttctatttacttctgctcacctcccaaaaccctcttctccttcccaggtacccactcctgatgatgcttctctttttgttggacatgccctgtgggttctttatcttattattttattttagagaccgtggcttgctctgtcacccaggctggagtgcagtggtgcaatcacaggtcactgcagcctccaactcctggactcaagccgcagcctcccgagtagctggcgagtagctgggactacaggcgtgcacccccatgcccagctaactttttctttttttcttttgttttttgagacggagttttgctcttgttgcccaggctggagagcaatggcactatctcggcttactgcaacctctgcctcccaggttcaagcgattctcctgcctcagcctcctgagtagctgggatcacaggcgcccaccaccacgcctggctaatttttgtatttttagtagagacggggttttgctatgttggccccggagttcaatttttgtatttttagtagagacggggtttcaccgttttcaccaggatggtcttgatctcctgacctcgtgatcctcccgcctcggcctcccaaagcgctgggattacaggcgtgagccaccgcgcctggccacggcagcatctcttctgaactccagagccattccctaccaccctctgggcaccaccatccacatctcctgctgccgcctcagccttaacctctgcaaaaccaaatccgttctttctctcgagctctgcagaagctaagctgtttcaccaggccacgattcaggaaacgctttgggattcagcttctgttcttgtgaaatgggaagaatccctgtggtgagctccagatgagagcacaaaggggaacaggggtgcccgcggctggcacgccatggctggcacgccatggcactcagtggggtcaccgccccctcctgctgtcccacctccaccctgcctgctcttctcctggaatgactccttctgccagctctcagctacccaggccagaggcccaaggctcccacatctctttagctactaattctggtagatccccttttggaaatagccctcaaatctaccccagagctactgtcaaagttcagggctccatctcttttggtttttttgaaaatattttttcaaattaattatttgttggccgggcgcagtggctcacacctgtaatcccagcactttggaaggccgaggcaggtggatcacctgaggtcaagagttcaagaaccagcctgaccaacatggtgaaaccccatctctacaaaaatacaaaaattagccagggatgatgctgcatgcctgtaatcccagctactcgggaggctgaggcgggagaaccacttgaacccgggaggcagaggttgcagtgagttgagatcacaccattgcactccagcccaggcgacagtgagactccgtctcaaacaaaaaaaaattatttgtggaggcagggtcccactatgttgcccaggcctcaagtggccctcctgccttggcctcccatagcactgggattacaggtgacagccaccgcgcccagcctactttttgtctggccaagactacctcagccttcttttgcctcccaatctgtctccagttggtggctgaagtgacccttctggagcaaaaccataatcatatcactccctcttttaaaattctgtgatgggtcaggcatggtggatcacacttgtaatcccagcactttgggaggccgaggtgggaggactgcttgagcccaggagttcaagaccagcctgggcaacatagcgagaccccccgtctctacttaaaaataataaaataaaatgaaaagaaaattttttttgagatggagtttcgctcttgttgcctaggctggaatacaatggtgggatctcagctcacggcaacctccacctcccgggttcaaccgattctcctgcctcagcctcctgagtagttgggattacaggcatgtgccaccatgcccggctaattttgtatttttagtagagacggggtttcaccatgttggtcaggctggactcgaactcctgacctcaggtgatcggcccacctcggcctcccaaagtgctggaattacaggtgtgagccactgtgtccggccaataaaatgaaattttatgatggcttctgcgatctggccaaattcctcagctaaatagtttagttctttctccctgtggcctctcctcccaccatgtcacctgtgaatcccacactgcccccaccccgacactgtctgcaggtgaacagatcagttttctcagccccaaatgtcagccccaccccacacctctgcctggcaaacatcactcaccggtcctcagagacacctagtcatttattccatgagtccaccacacttgagaaacgcttcttttcttcgcgagcacgcctaccctgtgctagacagtgttcctaagggctttcaaacataaagtcttttgttttttgtttttgagacgcagtcttgctctgtcgcccaggctggagtgcggtggcacaatcttggctcactgcaacctccgcctcccaagttcaagcaattctctgcctcagcctcccgagtagctgggattacaggcgctcggctttttatttttttaattttttttattttttgtatttttagtagagacggggtttcaccatcttggccaggctggtcttgaactcctgacttcaagtggtccacttgcctcggcctcccaaagttctgggattataggcgtgagccactgtgcccagcctccaactcctggccttgtcttcctcccaccctggcttcccagagtgctgggattaacagacatgagcctccacacctggcaacttctttccatttttcactgattctctgacacatcctcattgagcacctgcactgtgtggggtgttaataattgctaggcatggaggcaacagcgtgggcagctctttctcttacttgtcaggctttagcctatgctgttgcaggactgtgccttggcctggaagccccttcccttatcctcatccccaatctcccccttcagctcttgttcctcttgcaggtcttcccttaaacatcacttcctcagcaggggcctcacagacacgcccggaggttagatcctggtccctctgtgcttcctgttcttcccccatcatcacagtctacggctgtttcctctcgatgggcaaagactgtgtctggccattgagttttctgctatatccaagtgcttcgtatactgaaccatataaatgtgctgcttttattggtcaaaacggccaaatattggcaattttatattggttagcttcatagtatgtgagctaggatacttatcccatcagagaggttgcgtagcacagtgaatcagagcccaggctctggggccgcacacctgaggtccagccctggctctgccacttgtcactaagtgattgtggactggagacaaccctcaggggccttgggttcctaatctgtgacagggatgacaataatgacctcctcgtgctgttataaaatacagaaatgtactaaaatacaaaaattggccaggcatggtggcacatgcctgtaatcccagctactcaggaggctgaggcaggagaactcaggaggcagaggctgcagtgagtctacttttattgccaaagctcgggggtccatcccttttccattgcatgccactgcactccagcctgggcaacaaagtgagactgtctcagaaaaaagaaaaagaaaaaaatgtttaaaagccaggagtttgagaccctgtctctattaaaaaaaaaaaaaattaccttggcatggtggagcagctactcaggaggctgaggtgagaggaccacatgagcccgggagttcaaggctgcagtgagccatgattgcaccactgcattccactctgtctcaaaaagaaagaaagaaaaaagtcaagagaactggagctgaaaccatgaaaggtcagttttcagcaggagagtgatcaaagaaaaccagaactagacagtcgttaaaatagcaaaaacatattgcattccagactattgctgtaggggaagagtgaccttagatcagaactgggctgaactctacaccatgggggttatagccaacgagcagagttgggggcagtggatgggacattaccatgagaaagcactgggggttgggggtattctgacaagaccaacctaaagggattcttgctgagggcaggccaaggtggtcagacagcgcctgggggagagtggagaatgaggacccccatcagggatcgggggcaatcagatgtggaggatgagggactggctaagctgacttagcagtattcttgctaaaattggacgatgcagaggtgaacacggaagtccaaggcctaactggaaaagagctgagggaacctgagtgaggtttggctatagacagaacctctgagtgagcccatcaaagttactttatttatttgtttgtttattaatttatttaagacagagtctcactctgtcgcccaggctggagtacagtggtgctatctcggctcactgcaaactctgcctcctaggttcaagcaattctcgtgcctcagcctcccgaggagctgggattacaggcacatgccaccacacccagctaagttttgtgtttttagtagggacagggttttgccatgttggacaggctggtcttgaactcctgacctcaggctaattttttgtttgtttttattctctttttttttttttttgagactgagtttcgctcttgttggccaggctggagtgcaatggcgcgatattgactcactgcaacctctgcctcctgggttcaagcgattctcctgcctcagcctcccgagtagctgggactacaggcgcacaccaccatgcccggctaatttttgtatttttaggagagacggggtttcataatattggtcaggctggtctcaaactcctgatctcaggtgattcgcctgcctcagcctcccaaagtgctgggattacaggcgtgagccaccgcgcccagccttttgtttgtttttaaatttaactttttttttgagaccgaattgcactctgtcacccaggatggattgcaatggcgcaatctcagctcattgcaacctctgcctcctgggttcaagagattctcctgcctcagcctcccaagtagctgggattacaggcgcctgccaccacagctggttaatttttgtgtttttagtagagatgaggttttgccatgttggacaggctggtcttgaactcctgacctcaggtgatcaacccaccttggcctcccaaagtgctgggattacgggcatgagccaccatgcccggccttaacttttatcttaagttcaggggtacatgtgcaggtttattatataggtaaacttgtgtcatgggggttgtacacattatttagtcacccaggtattaagtttagtacccattagttatttttcctgatcctcttgagggaagagagagaccctctcatattgtttcatactcagaaaaggaaagagaagcgaaactaaaggcaggtagcctggtgcctaggaaccagaccggaaaccaaggaaccagacccgaaatcaggcctgggcgtgcctgacctaagcctggtagttaaaattcgacccctgacctagcaactgttgttatctatagattccagacattgtatggaaggacattgtgaaacctcccgttaggttctgtttcactctgaccaccggtgctcgcagcccctgtcacgtaccccctggcttgctcaatcacgaccctctcacgcggacccccttagagttgtgagccgttaaaaaggacagaagttgagcacctgaagagctcggattttaagacgctagcctgccaatgctcccagctgattaaagccactcccttcactatcttggtgtctgaggggttttgtccacagctcgtcttgctacacttgccctcctccaaacttccgccctccaataggctccagtatgtgttattcccctctatgtgtccatgtgttctcatcatttagctcccacttataagtgagaacacgcggtatttggttttctgttcctgcgtttgtttgctaaggataatggcctccagcgccatccatgtccctgcaaagaacgtaatctcattcttttttgtggctgcatagtattccacggtgtatgtgtaccacactttctttgtccagtctagcattgatgggcatttaggttgaatcatgtctttcctatggtgaatagtgctgtgatgtgtctttataacagaatggtttacattcctttgggtatatacccagtaatgggattgctgggtggaatggtatttctggtttttggtctttgagaaattgctgcactgtcctccacgatggtttaactaatttacactcccaccaacagtgtataagtgatcctttttctttgcaacctcgccagatctcggtggtcaactcctcccactccccaggcaatgctgatttgctctgtgcctatagttttgcctttcccaggatgctgcgggaatgggatcatacggccttttggatctggctccttttagttagactgatacatttgagacaggtccctattgttgtgtgtatcagtagttggtttcttctttttttgagatggattctcagtctgtggtccaggctggagtgcagcggcatgacctcagctcactgcaaactccgcctccctggttcaagtgattatcctgcctcagcctcccaagtagctgggattacaggcacatgccaccacgcccggctagtttttgtattttttcgtagagatgggatttcaccatgttggagaggctggtcttgaactcctgacctcgtgatctgcccaccttggcctcccaaagtgctggaattacggcgtgagccatggtgcccagcctgcatcacaggttgtttacccaatactcaccagttgcagaattcaaatccattttttaaaaaatcagcctgaaaaaaaaagaaaaaaatcagtctggccaggcacggtggctcacgcctgtaatcccagcactttgggaggccaaggcgggaggatcacctgaggtcaggagtttgagagcagcctggccaaaatggcaaaaccctgtctctactaaaaatacaaaaattagctgggcgtggtggcgggcacctgtaatcccagctacttgggaggctgaggcagaagaatccctggaacccgcgggacggaggttgcagtgaggtgacatcaggccacttcactccagcctgggcaaaagagtgaagctctgcatcaaaaaaaaaaaaaaaaaaaaaaaaaaaaaatcagggtgggcacagtggctcactcctgtaatcccaggactttgagaggctgaggtgcgaggattgcttaagcctgggagttcaagacgaggctggggaatatagtgagacccccatctctacaacaaaaaatatacaaaaattagccgggcatggttggtgtgcgcctgtagtcccagttccttgggaagctgaggcgagaggattgcttaagcctgggcagttgaggctgcagtgagccatgatcgtgccactgcactgcacctagtttgaatggagtgggagtgggggattaggctctcctccctgccgtttgctcccaggccttttccgtagctggatgtgaccaacagagacagtgcccagcctcagtatagctagctcttagtggagggacaggagccatctggggcagatgtgggagagaatgtggcgaaggagagccgggtgcagtcaaggaggcttgtggctcggaggggaggtggggtgagtgagtggagactcagcagcttggctttggggaagtagacaagagagggccctctttggagagcggagcaagccaggatgtctggccttcacttccacttggaacagaagtgtgctgtgtgcgcgtgcttgtgcgtgtgcgtgcacgtgtgtgcgcgctaaatcaaacaccctcgctggctctgtgttcccctcaaggggaagccaactccacggatggcgggggtccattaggctgcaggtcttctccctgccgatagatggcgctgttgcaccgcgcctgggtttgcctctgcccgcagccatgcagggcccatcacgggctatgcctaccgcgcgaggggccttcaccatgtccactatccttatttatttatttatttatttatttatttattttttaagtgtgggtactggccgggcgcggtggctcacgcctgtaatcccagcactttgggaggccgaggcgggcggatcacgaagtcaggagattgagaccatcccagctaacacggtgaaaccccgtctctactaaaaacacaaaaaaattagccaggcgtggtggtgggcgcctgtagtcccagctactcgggaggctggggcaggagaatggcgtgaacccgggaggcggagcttgccgtgagccgagatcgcgccactgcaacagaacgagactatctccaaaaaaaaaaaaaaagtgtgggtatatagtaggtgtatatatttatggggtgcacattgataaaggcatgcaatgcataataatcacatcatgggctagatgcggtggctgacgccgagatcgcgcctctgcagtcgccaggccactgcaggcgccacagtggcgacagagcgagactccgtctcaaaaaaacaaataaataaataaatcaggttaggccgggcgcagtggctcacgcctgtaatcccagcacttgggaggcggaggcgggcgaatcacgaggtcaggagttccagaccagcctggccaacatggtgaaaccccgtctatactaaaaatacaaaatttagccgggtatggtggcaggcgcctgtaaccccagccactcgggaggctgaggcaggcgaatcgcttgaatccggaaggcggaggttgaagcgagccgagatcactccattgcactccagcctgggcaacaagagtgagattctgtctcaaaaaaaaaaaaaaaaaattacatcatagagaatggggtgtccatcccctcaagcatttatcctttctgttacaatccaattgcattcttttagttatttcgaaatgtacagttattattgactgtagtcaccctgttgtgctagcaaatagtaggtcttattcattctttctattttttttgtacccattaaccttccccacctccccatcatccttttttttgttttgagacggagtcttgctctgtcacccaggctggagtgcagtggcacgatctcagctcacttcaacctctgcctcctgggttcaagcgattctcctgcttcagcctcccgagtggctaggattacaggcctgcgccactatacttggctcatttttttcggggttttgccatgttggccaggctggtcttgaactcctgacctcaggtgatccacctgcctcagcctcccaaagtgctgggattacaagcatgagccactgtacccagccccatcatcctcattttatttattttttatttttattactatttttttaggtggagtcttgctctgtcacccaggctggagtgcagtggcgtgacctcggctcactgcaacctctgcttcccgggttcaagcaattctcttgcctcagcctcccgagtagctgggattgcaggcgcctgccaccacgcccggctaatttttgtatttttagtagagacaggagggttttaccattttggctaggctggtctcaaactcctgacctcaggtgatcctcccgccttggcctcccaaagtgctgggattacaggcgtgagccaccgcgcctggccagactgattttttttttaagtgaatttgaaagctgcaactggtgagtattggataaacaaactgtgatgggattgcaggtgtccacccccaagcctggctaatttttgtatttttagtagagaccatgttggccaggctggccttgaacccctgacctcaagtgatctgcctgccccagcctcccaaagtgtttgggattacagtcgtgagccaccgcacccggtcagaagtttaatttttttttttgagacggagtcttactctgtcaccccggctggagtgcagtggcctgatctcggctcactgcaagctccacctcccaggttcacgccattctcctgcctcagcctctggagtcgctgggactacaggcgcccgccaccaagcctggctaattttttcgtatttttagtagagacggggtttcaccatattagccagaatggtctcgatctcctgacctcgtgatccgcccgcctcggcctctcaaagtactgggattacaggcgtgagccaccgcgcccggcccagaagtttaaatttaactaggtgcccagtgatctcatcaagcccacagcactccctcaccctcgcccccacaacctcccttccccccacgccccccttcctcaccgcagtcccccccctgggacccctagatcttgaggctgatgggccagttcccagtttcactggttgttaaatattttgacagtgacccctgacagcaggagaggcagccaaactcaacagctgttctctcttccccccaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggtgctggtcctgcctgtccctggtccaaccccaccctcagcacacccctcccctcccctcccctctccagagcctccagccatgaccgggtgaacagccatggcctggagtcagcaacacaagactcttcccacctcagctcctccatctgagctgggctcagttgagctcatccagctaagctaaaggggagctgggcctgcttttctttttctggagatggggcctcagtctctccagtagctggatatacaggcatgctccaccccactggctaatttttgctttttttttttttttttttttttgagatggagtctcactctttcacccaggctggagtgaagtgatgcaatctcggctcactggaacctctgcctcctgggttcaagcaattctcctgcctccgcctcccgagtagctgggattacaggcgccagccaccatgcccggctaatttttgtattttttagtagagacagggattcaccatgttggccagactggtctcaaactcctgacctcaggtgatccacccacctcggcctcccaaagtgctgggattacaggagtgagccactgcacccagctgccttttttttttttttttttttttttgagatggggtctcactatgttgcccaggctggtctcaaacttctggactcaagtgatcctcccaccttggccacccaaagtgctgggattataggcataagccaccatgcctggttttggaattggttctttatctttgttctgctgctgcgtggcgtgatgttcaagagcaaaggacaacacaggggaagccagtgtcactggcaccacagccttgagcccatctctctagccctctgcaccttatttcccatctgtgaaatgcccttaaacaccccttctaattttaatattctgagtcaaattgagctcaggtccaaatgccaaatattgctgatattcatccactttttgacccacaaaagtggtcattttaacctacaataaaacatcctggctcagtggctcatacctgtaatcccagcactttgggaggcccagttggggggattacttaagtccaggagtctgagaccagcctgggccatatagcaagattctgtctctacaaaaaattaaaaaattagccatgcttgtgggcaagcccctgtagtcccagccacttgggaggctgaggtgggaggatcacttgatcccaggaggtggaggctgcagtgaactatgactgcactgaactccagcctgggcgacagagcgggaccctgactcaaaaacaaaacagtggccaggtgcggtggctcacgcctgtaatcccagcactttgggaggctgagatgggtggatcacgaggtcatgagttagagaccatcctggccaccatggtgaaacgtcgtctctattaaaaatacaaaaattagctgggcatggtggcacgcacctgtagtcccagctactcgggagactgaggtgggagaatcacttgatcccaggaggtagaggctgcagtgagctatcattgcaccactgcactccagcctgggcgacaggttgagaccctgtctcaaaaacaaaacaaagcaaaaacaaccccaaagtctggtttccttattaaccccaagttcatggtccacccgaagcttttcaaatgtcagtcccggctccccgcgccccagctgcagtgctgggccctatcgtcaccctcgccctcccggctccctgcgccccagtgccaggtgctgggcccagtcctcacccttgtcctcccggctgcccagcaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggtaaggtgggctctgcctccggggagggatctgtggtgggctcttacctccccttggcttgtgtcccgcaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaagaaagagagaaagagagagggagggagggagggagggaaaggaaggatggaaagaaaggaagaaaggcaggcaaaagccccagacaggccaaaaccttcatccttcatgcacccaacctgtaccaaacaccagcatggcctggctgtgagtgcacagcagatggaggtttgctgggcagagacactgggctggcctagacactgcctttggtgataccctaaaccaaaggggccagtcccacagtaagaaggagaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttctttaatccggtgcctgaggagttttgtctgtggctcgtcctgctacaagaggacacagcccagaggtgccacctgcagctgccctgtcccctctaatcccagctccaccctgcctgctcccgtccttcctccagggggaacatggacacgctcagatgaaccccagcttcttatgcctgaactggggaaactgaagccccatgggaccaggggttccactgggcatcaagggaggaaagttgagccccggggtgatctgggaactgggatctgggatctgggcaggcattggggcctgacagagcagaagtgaggagagggtaccaggagctgcaaactcggtgcctccaggacctattcggataaaataaatgggtggaactggaataagacaaagtgggggtgcgctgtggccaactggaaaatgctcgttgcagccacagcgttccattaaaaaagcgaaaggaacctgcctgcctgagtcttaagctccccctaaacccagaaatgggttagccctccagtatcctccagctctgagagctggggcgggcactccattactgggggaacaggaaatggatcctgggcactctagggcaacacacgccctccttgcagggaaatggatttccaggcaggggagatgcatgggcagaggtggcttggattgtttgctgtaagatttgaagctgtgatcaggaggtggctaggagatgggctgggtccagaccacaaaatggtagatcggaggatttggactctgtctcatgagtgagctggaaatcaagctggaaaatcagataagcttattcgcagcttcaatccagtccgttgcagaaggatgcatttgagggggctagagcagctgcagggaggccaggaggagctgtggaagaggacttgagtgtgggtcatggccatggggtttggagagaagtgatacagtgtcttcagagcttcagaaggcagagggagttcgatggctcaaggcagttggaagagttgggtgtgactgagggggtggggaaatggggcatgcgtggcaggcaaggactcttatgcatcacctcccagtcccttgtccatctggctacacttcctctttgcctggccagcctaggaccaagctgggatcatttccccaggatgccccacagacaatggcaaatgtgcccatcatagcagtttgtttaatgaaaatgatatgctgttgtgagtacgggatgtgccagcaatgctggctactgcatgagacgggagctagcagggagcaccttcatccagggtgtgcaggtccccttccctcagttaatgctcgtgggggcgggcgttagcctctccacttaccgaagaggagactgaggctttataaagttaagagagctgcttagggtcactcatcaataaagtggtggaggccagtcatggtggctcacacctgtaatctcagcactttgggaggctgaggcaggaggatcacttgagcccaggagttcaagaccagcctgggcaacatagtgagactcaatttctatttttaaaaaattatccagctgtggtggtgcacacctgtagtcccagctactcaggagactggggtgagaggatcgcttaagcctgggcagttgaggctgcagtgagctgtgactgcaccactgcactccagcctgggtgacagaggccctgtctcaaacaaaaataaataaataaataaatatataaagtggtggagcagtttgaattgtgtcattcactcattcaatatttaactgagcatctactgtgtgccaggcactattctagacaatgaacatacaacgagtaaacagataaaaatctctgtcctcagggagtctgtatgttggggttggggtgggggcggggaagaatagacaatgaaaaaatacttaaggaaaatatgtagacaccaattgtcctgatggccacccctgatggccaccagagggcactgcaaccacgcggccctccgttcgtctctaattccagctccctttccggattccgaaggcaatagccaaggaggctatgaatacgcagcatagcatctgctcaagaatcaacgcgaggaggcattggcagcagttttttctccacccacttttccagcctcatcccctcatcagacccccatccaactgcccagggtacccctgtgacttttcaaagccccgtgtactccagattcaccagctactcacattcactcccagccacccatcccctcccaaatactgtctgggttacccaccaaccccatccatccgctcacctgatgcctgtcctcctcctcacccacccacccgcgcccctcgccccttccacctgctgtcctgcccaccggaaactggccaaattgtcccatagatttttttttttttttttttttttttggataaacacagaaattgacattcctggtcttaaagcttgaaacttaaatttgccttatctgagttccttccccaggaaactgaccctcaggcctcccagatagcatcaaggaactgaaactccttttctttacccccctctaattcctgttttcccacccacagctacatttgctccccactatataaacccccaattggagtttgttggagagatggatttgagacttatctcctgtctccttggcagatgtcatctgaataaagccttctttcctggcgatactcattgtcccgggatcccagatcagctttctgtgcagtaagcaatgggacctagactgaatccctggcgtttcggtaatacacccatccatcctgtccacccccacccatcctgtccacccccatctatcctgtccacccccgacccatcctgtccacccccgacccatcctatccacccccttgtgcttccatccactcatcactcttcccacccctccgcccacccaccatccgatgctacagaagcccagaactggggcactcaatctagaggtcaaagatggcaagaggtcaaaccagattgacagtgagtcacctcagtggatatgagttttagtgtgctgaggccgtgaaaggtaaaagcatttaaaaacagcaaggccaggcacggtggctcacgcctgtaatcccagcactctgggaggccaaggcaggtggatcacctgaggtcaggagttcaaagctagcctgaccaacatggggaaatcccttctctactaaaaatacaaacttagctgggcgtggtggcatgtgcctgtagtaccagctactgctacttgggaggctgaggcaggagaatcgctgaacccgggaggcggaggtttccatgagccgagatcacaccactgcactccaccccggggaacaagatcgaaactctgtctcaaaaaacaaaaacaaaaaacccacaaaaattagccaggcgtagtggcgggtgcctgtaacccagctacgcaggaagctgaggcacaagaatcacttgaacctcaaaggcagaggttgcagtgagccgagatcatgccactgcactccagcctgggcgacagagtgagactctgtcccaaaaaaaacccagagcaaacaaacaaaaaacacaacggcgagacattcttagcaaaccaactatctgcaaacaattcaacgtcggatctttaaaaaaatcccgctgtggcattatgctgcggacacatacattaatttatggctagcccttcaagacaaccaggtgggtaaaattatgtaaatgttcaccgcctctatactttgttccaatgacttcctgagtaattgattgttttgccaattactcagcaacatttaagacctgcttccggaggccctaagtagctcagcattctaagaccgaagtactgaagaaaatctgcctgtgtggctgtgaataacatctccatccgtcactgtgcacatcagatttaggccagataacgcaggctttatttatttcaggtacgccttgcgcttcagatcatgggactctagtatagcacccccagaaaattatcaagggcaaaaaaatcataatacatacctctagttcagtgggtccttggataacctctttcctctctcctagttcttcagctaaaagattcaggagccttagcaacaagaaggagctatcccacaagttgcattattctagatattcggacacttttttttttttttaagcaggagtcttgctatgttgcacaggctggtcctgaactcctgtccttaagtgattctcttgccttggccttccaagtaactgggattacagcggtgagccaccgtgccagggttttggatgctttttttttttttttttgagacagagtctctcttgtcgccctggctggagtgcaatggtgtgatcttggctcactgcaacctctgcctcccgggttcaaacaattcttctcccttggcctcccaagtagctgggattacaggtgcgtgccactacactcagctaatttttgtatttctagtagagatggggttttaccatgttggccaggctggtctcgtactcctgatctcaggtgatccgcccaccacagcctcccaaagtactggggttacaagcgtgagccatcgcgcctggccggatactttttaaccaaaggaaaaagcaagcatctttattggaataatatatcaatatatgcaggtaatcagacaataccagtcagacaacactgacttctttttttttttttttgagaaaggaaggaaggaaggcagaaaggaaggaaggaaggagggaaggccggaggtggtggctcatacttataatcccagcactttttgaagcccagaagggagatcacttgaggccaggagtttgagaccagcctgggcaatatagagagaccccatcttgacaaaaaatttaaaaattagccaggcatgataatttgcacctgtagttccagctacccaggaggctgaggcaggagaattgctggagcccaggagtttgaggctgcaaccagccgtgactgcaccactgcactccagcctgggcgacagagagataccctgtctcgaaaataataaataaaggccgagtgtggtggctcacacctgtcatcccagcactttgggaggccgaggcaggcagatcacctgaagtcaggacttcaagaccagcctggccataatggtgaaaccccgtctctactaaaaatacaaaaattagccaggcatgatggcaggcgcctgtaatcccagctacttgggaggccaagacaggagaatcgcttgaacccgggaggcggaggttgcagtgagccaaggtcgtgccattgcactccagcctggagaacaacagcgagacttcgtctcaaaataataataaataaataaataaataaatatgtaaaaagtcccttaactgaggccaggcgcagtggctcatgcctgtaatcccaacacttcgggaagccaaggagggtggatcacctgaggtcaggagttcaagaccagcctgaccaacatggagaaaccccatctctactaaaaatacaaaattagctgggtgtggtggcgcatgcctgtaatcccagctactcaggaggctgagagaggagaatcgcttgaaccctggaggtggaggttgctgtgagccaagatcacaccattgcactccagcctgggcaacaagagcaaaacttcatctcaaaaaagccccttaactataatctaagaaacaaaaaatatttaatttttattttctgcatgatctgcttagttttcttaataagctgtgaaccagaaagggaatttgctgcggtttggcagccttttaggtggaggattatagtgaatacatttttagattattggtatagtaacttccccaaaggatgtaagattttgaggactaaaccaagtcctgcactttccattccaacctaattaattccagtgaatgaaacattcattggggaaagcacagaagatgcagaagagctgcttacatgacctgagtcaacaattcagtgaccctctgcgtataataatcaaaatagggccaggcgcagtggctcacacctgtaatcccagcactttgggaggccgaggagggcagatcacctgaggtcaggaatttgagaccagcctggtgaaaatggtgaaaccccgtttctactaaaaatacaaacaattagctaggcgtagtggcgcacacctgtaatcccggctactcgagaggctgaggcaggagaatcgcttgaacccaggaggcagaggtcgcagtgagtcgagatcgcgccattgcactccagcttgggcaccaagagtgaaactcggtctcaaaaaaataaataaataaaaataaaaatagaacaataaagtccattcataaattttctagcatagttaacttatccacctcctcttgcttttcgttaattaatttagttatcagagtacaaaatgaaaaagtaaaaaatatccattcactctcattcccatgaggtaaccacgtttaaggagctctgtgtttttagtcctcctggcatctacacttgagtggaaaagatgatcatttgtggttttaagcactattgactccctgatgtgaagaacaaagaatgtatctcactcattctttttttcttctttttttttgtgctgtttttattggtagtcttcctactagttatcatcataactttaaatgatatatttaatccccttttcttgaagcattgtttttatttttatttttttacttgtatttatttatttattgagacagagtctcactgtgtcacccaggctggagggcagaggtgtgatcttggctcactgcaacctccgcctcctgggttcaggcagttctcccccttcagcctcccgagtagctgggattacaggcacccgccaccatgcccaactaatttttgtatttttagtagaggtggggtttcatcatgtcggccaggctagtttcaaactcctgatctcaaatgatccacccaccttggccttccaaagtgctgggactggccggggatgatggctcacgcctgtaatcccagcactttgggaggctgaggcgggtggaaatcacaaggtcaggagatccagaccatcctggctaacacggtgaaaccccttctctactaaaaatacaaaaaattagccaggcgtggtggtgcatgcctgtaatcccaggtacttgggaggctgatgcaggagaatcgcttgaacctggaaggcggaggttgcagtgagccgagatggtgccactgtactccagcctggacgacagagtgagactccatctcaaaaaaaaaaaaagcaaaaaactccacaaagtgctgggattacaggcgtgagccactgcgcctggcctgaagcatcgtttttaaaattcagatataatttacatcgcatatacttcactgctttaaagggttcaggctgggcacagtggttgacacttgtaatcccagccctttgagaggctgaggtgggggggatcactcaaggccaggaatttttgagaccagcctgggcaacatagtgagactcgctctctaccaaaaaatttaaaaatgagctgggcaagatggcacacacctgtggttccagctacttgggacgctgaggtaagaggattgcttgaggccagaagctcgaggcagcagcgagctgtgattgcaccactgcactccaacctgggaaacagagtaagaccccttctttttttttttttagatggagtctcgctctgtcgcccaggctggagtgcaatggcgcagtctaggctcactgcaacctccacctcccaggttcaagcgattctcctgcctcagcctcctgagtagctgggactataggcgcccaccaccacgcccagctaattttttgtattttcagtagagacggggtttcaccacattggccaggctggtctcgaactgctgacctcatgatctgcctgcctcagcctcccaaagtgttgggattacaggcatgagccaccactcctggccaaaaccccttcttaaaaaaaaaaaaaaaaaaaaaaaaaaagaacatccttttttttttttttttttttgagacagagtttcgctctcttgcccaggctggagtgcagtggcgcaatctcggctcacctcctgggttcacgccattctcctgcctccatctcccgagtagctgggactacaggcacctgccaccacgcctggctaattttttttgtatttttagtagagatggggtttcaccgtgttagccaggatggtgtcgatctcctgacctcgtgatccgcacgcctcggcctcccaaagtgctggaattacaggcgtaagccaccgttcccggccaaaagaacatcttaataatcccagaaagattgggcgcagtggctcatgcctgtaatcccaacactttgggaggttgaggcaggtggaccacgaggtcaggtgttcgagactagcctgaccaacacggtaaaaccccatctctactgaaaacacaaaaattagccaggcatggtgatgcatgcctgtaattccagctactcaggaggctgaggcaggagaattgcttgaacctgggaggcggaggttacagtgagctgagactgtgccattgcactccagccagggtgacagagtgagactctgtctcaaaataaataaataaataaataaataaataaataaataaaataactccagaaagaaactcccttcttgtgatatcaagtacatctccctcctctcagccaatggcaaccattattctactttctgtcttgatggattttatctacatagaattgagggaagagagaacttctcatattgttttatattgttttatactcagtacctgttttaagaaaaaacaacaagaaagtaaaatcaaagacaggcagcccggcgccaggcccgaaaccaggcctgggcctgcctggcctaaacccagtagttaaaaatcaactcataacttagaaaccaatgttattcatagattgcagacactgtatagaagaacactgtgaaactccctgccctgttctgtttctctctgaccaccggtgcatgcagcccctgccacataccgcctgcttgctcaaatcaatcacgaccctttcatgtgaaatctttagtgttgtgagcccttaaaagggacagaaattgtgcattctgggagctcggattttaaggcagttgcttgctgatgctcccagctgaataaagcctttccttctacaacttggtgtctgagaggttttgtctgcggctcgttctgctacagaagcatacaacacatggccttttgtgcctggcttcttccattcagcatgtttctgagggtcatccatgttgtctgtacttcattccttttaatggtttccattgcatggatatactacattttctttacccatgcttcagttgatggacatgtgggttgtttctacgttttggctattatgaattatgctgctatgaaaattcatgtactggttttggtgtgggcacacgttttcaatttctcttgggtgtatacctaggaatagaattagaaaatcatgttggctgggtgcggtggctcacgcccgtaatcccagcactttgggaggccaaggcgggcggatcacgaggtcaggagatagagaccatcctggctaacacggtgaaaccccgtctctactaaaaatacaaaaaattagccaggcgtggtggtaggcgcctgtagtcccagctactcgggagactgaggcaggagaatggagtgaacccgggaggcggagcttgcagtgagcagagattgcgccactgcactccagcctgggcaacagagcgagactccgtctcaaaaaaaaaagtcatgttttactttttgtggaactgccacactggttttcaaagctgctgcttgtacattccactagcaatgcacaagggttcctatgtctccacatccttgtcaacacttgttattgtccatctttttaattatagccatcctagtgagtgtgatgcagtacctaattgtggttttgatctgtattttcctaatgattgatgatgttgaacatcttttcatgtacttatagaagttattaaaaaattactttaggcagatggagaggaaaaggggtccttggaaagttgtttcttttaaagcaactccagaaacgtttctggtttaccaggaaagccctggctcttagagcccagccagcaacatttgatatgcaaatgcagaccattagaaactgggtccacccaaacatggcgattcccaccgttgtcctcttgcccttgcccccacatgtgcctggcaaatggctacccctacatatcccccacctgtgtaaaacatcatggtgccctgcatttgcatcttaaaaggctagggtgagagggccagttttttcgtgggctatatgaatgacatgcctggttaaaccaatcccctaagccctatgcaaattagacaacacctcctccagcctcctcatatacccggttggtatgccccgcatttgtggtctcctctcttggctttggagcccccctccctctgtctctgtacgggggtgccttcttcttttcttcttctcccttctttcttgcctattaaactctccacttcttaataccactacacgtgtatctgtgtcattttatccaatttgcatgagacaagagccctggtgcccctccactcatcagagccgtatcattttggtgcatgggccaggaaaatccaaagtacagccttcgttggagtggtgagtatgggagcaatcctaaaatctgttctatcattacgaggcgctcttagcctctatattaaaataaatcaaacgggcgtccgtcagcctaatacataggcttagcattggctgccgtactaaagactcggatgtgaggcttgctggggagaacttggagaatcccccattacccacaggtactgggaattttggccatgtttgaactagcttctttttgttagggataacgctcaaaatcctaaggaaattgaacactcgaacaaaggattcttagcaaagcaattttacttctgcacagagggttgcctccttggccagttgccatgagagcacacctgaacaaaggggcatgagagcctttatttgcgatggaagtcctgcccctgtaccctttcctcattggctggggttgggtcatacaatctaaactaatcccggttggctaaacatttcattttttaagatagggtgggcacgtaaaaacaagtggagaggaaggggaaggggtgtctgtaatgagctagaaagttagtcatttttccaaataaggaaaggaatgtgagctggtactgataacgcttggtactgtggtgtgcctgggcatctaacaaaggcaaaatggaaaaggagaaagaaggagaaaaaagggggggggtacaatgaattaaagaatgaaagattgatgagattatttgaagagaaacctcatcatattccacattttcacagggagaccttgccatcatgcgaggctgggaaaacttctgaggtaactgagaatttctggtcagggcacactctggcatgattcaagggcctctggaccggacgcagcctccgacagccgggtgttggcagagaatcctcaactatcctgtggccaaattttctttctgtctctatccatggtctcttaccctctctgtgtgtctaatgtgcagggatctttacagttcagggaaacaggtctgctagaagagatggtgaatcacggcagccagtaactcaataaacgtttctctatggtttctctggtgagcacgtggtatttctaagccacctagtggcaataaaaatcctcttcatgagacacattgctggttctctacggtacattgcagcttcgcaatttttctattttgcgcttttttactgctatttctgtgaacgggaaggctctgcttttaacaggagtcaaatgtcttctgcagccagattttagtcctaatattgtcccatcagtagaaattggccatttgcttcctacgttcttttaaggcacctattctgtctccagttaagatagtacttaattagtagggaaattttaagtctggaagttaaccggaaccattttcctatgggtaaatgttttatcataggccataatagcaggatttagagttcaatctagcatgccccctgccttaaaggggtcttgcccaattacatgatttttcttgaaatccatttttttaggaaggcacaaaggccacacaagtctggaaggtcaaagagaaataaaaggcagaggactaaggctgcttggggaaagcgtgactaaggctcaaaagttgagttcctctgatgtcatggcttggagggtcacgcctgcagtcacaggtcactggtggcccatttaaataggtgctgggaatccagaaaccacggagagaagatagttgggggaactccccctactgcttttgtctccaacctggatcacataccaaaaggaaggagactaaaagaacgcttttattctcacttctctttctagatgggaattagatcatgtataacatgcactgccctcgagtgtattttaaagcactgggactccttcaactctgaaactttgaagaaaaagtggcttattttcttttacacaagggcatggcgtatttgtttttgttttttttttgttttttttgtttttttttttttgagacggagtcctgctccgtcactcaggctggagtgcagtggctcgatttcggctcactgcaagctccacctcccgggttcacaccattctcatgcctcagcctcccgagtagctgggactacaggcgcccgccaccacgcccggctaactttttttgtatatttaatagagacggggtttcactgtgttagccgggatggtctcaatctcctgacctcgtgatccacccatctaggcctcccaaagtgctgggattacaggcctgagccactgcccccggctgggcgtggcctttttactaaacttctgcaagcgttgcaaaatcaacctagctcttttagcaatcacatcaggcaggcccaaagagaatgattacccaaaattagagaagccagttctaggggaaccacctgaggattcctttatttggggccccttcaagttcctttctcattatttaggaccttaggcaagtaaagggagacttaggccaattttctttctttctttatttttttttgaaacatagttttgctcttgttgcccaggctagagtgcaatggcgtgatcttgactcactgcaacctccacctcccgggttcaagcaattctcctgcctcagtctcccaagtagctaggattcacaggcgtgcatcaccatgcccagctaattttatgtttgtttgtttttttagtagagacagtttcaccatgttggtttggctggtcttgaactcctgacctcagatgatccacccgcctcagcctcccaaagtgctgggattacaggcgtgagccactgcgcctgtccaatcttctaatgaccctgataggtatacagaagttttccacaatttaactcaggtatttaacctctcatggaggaatgttatgctgctcttaagccaaaccctaactgcagttaaaacaggcagctctgcaagcagaagaaaattttggagataagcaataggtctcctatagtaggccaaaagggaaaagaaaaaatagggaaggcaaagaaataggggaaacaatatttccaataggaaaagaggcaatacctcttggcaaccctatttgtcactcctttctatggtgtttttccttctttcacggtttaaaatggcttctatctcttttataatgttcttccaacctgggaaaagttatttttccaaacgttaaaatgcttggcttagagttgagctagggggaagggaacacagaagcctggtatgctggcaaaagggtaaacatttcttaccagatgggcttttggcttctccctgtgcaaaccggtaaaagggataataaggatcattgtttatattctctgtaaatttctaattcataaaaaaggatttgtgaggttggtcttaagctgtaaacaatctggtgtgctttgcatgtctttccctaagaaagggtatcttaggttaggatgcaggcctaggaccccataagcctggtgtttgagcgagcccaacaaaatcgtcactaacaaaattggctataagccttcatcttgtttcatgtccttggaaacatgacctgtaaccacgtggcaatactttgtttgagtctccaccatttcataatggtggctgtcttctggtgctaagtcagtttctgggtgagggccacaaaatcagattaagtcggtttgtcaatctgggtggtgccagctgatccatcaagggcagggtttacaaaatatcttaaacactcattttaagagtagtttagggagtgtcaaaatcttgtagcctccagatgcatagctcctaagccatagtttccaatatatatatataattttatattatatatatacataattttatattatatatattaatatataatatatataattatatatgttaatatatttaatatataattatataaaatatataatatataattatatatgttaatatatttaatatataattatataaaatatattaatatatataattatatagttaatatatttaatatataattatataaaatatataattatatataattatataaaatatataaatatatataattatataaaatatataattatatataattatataaaatatataattatatataattatataaaatatataattatatataattatataaaatatataaatatatataattatataaaatatataaatatataattatataaaatatataaatatataattatataaaatatataaatatataattatataaaatatataaatatataattatataaaatatataaatatatataattatatataattatataaaatatataaatatatataattatataaaatatataaatatatatatatatatattttttttttgagatggagtcttgcactgttgcccagggtggagtgcagtggcgcaatctcagcttgctgcaacctccacctcccaggttcaagtgattctctttgcctcagcctcacaagtagctgggattacaggcgtgtaccactacacctggctaacttttgtattttcagtaaagacagggtttcactatgttgaccaggctggtttcgaactcctgacctcgtgattcgcccaccttggcctcccaaagtgctgggattacaggcgtgagccaccacgcccagcctggtttttaatcttatggctagtttcttggtctggtccccagacaagagggaagtatatcttaagaaggggctgatatcatctttgttttaaactatctatagtttaataactataaactatctatagtttaataactataaactatagcttaataactataaactatagtttaataactataaactatagtttaataactataaactagtttaataactataaactatagtttaataactataaactatctatagtttaataactataaactatctatagtttaataactataaactatctatagtttaataactataaactatagtttaataactgtagttttaaactatctatagtttaataactataaactgtctatagtttaataactgtaaactcgcccctcccaaagttggtccagcctacacccagggatgggcaaggacagcttgggggctggaaacaaaatggagttgtttgggtcggatctcttctctttcactgtctcagtctcagttttgcaatgacagtttcaaaagctgcctattactcctttgaaaataccttgtacacttgtggataagtcataacctaattaaggctcattgggttcacctgtgaggttactttttgtaaaactcaaaagccaaaaatcttaactgcttggcatggctaaagtcaagtaacaagggattttgaaggcttttcttagagcactcagcttaattaaaagtggatattcaagttataggtatacttaaaaggcctttatgtttttctcttcttgaatcttgttttctggaaaaaggctcttctcagtcaactgaattatttttctccatttttgtcttaaccactcttaatgcatgcatgagagtccctaagacaacttctgacagcatggaactccttgggaaaaacagaggaggtgccacaaaccctgttttggaaaaaaaacctgttttcctcatgaaacccccaaaattaaaagctgatagttccctctcaaaaccaaaggctctgttctgttatgtattgtgttatctaccgttttgagttttgggggtatcaaattacttcacattataaaagagctttgatgtgtaataactaggtagaaaatacactgtaaaggatgcctaatagtagttataaatcaaaaaagcatgctcttgggcacctaaaaaacatccccaccccccacaaagagatgagactaccatgcagaatgggctaattgccaaaataagccaattggctttgggttgccttgcaatgaaatgcatggtagaaacactacactgtcttctctcatagtatctatatggtcttttcataaattgagcattgaaataaaagcatagcaaggagttcctaaaacactaatctgtcctttggtaaaaaggttataaaagatttgtaaagatttaactgtaactgtcctggaaattttgtcattcgcaaacaattgttgtcttgcttcgttccttctcagaaaatggtttataatcaagctatattaaggactttaacaggtgttctcaaatgcaggtttttaatagctttgaagattgtaacattggaataaaaaagtacaggactcataaagaatggacatattcacaaatatcaagcaaaacaaaagttaactaaatggactgcactcaaaaagttaaagcagcttttttttttttttttgtgatagagtctcactctgtcacccaggctggagtgcaatggtgcaatcttggctcactgcaacctccgcctccctggttcaagggattctcctgcctcagcctgggattacaggcgcccaccactgcgcttgacaaatttttgtatttttagtagagacagggtctcaaactcctgacctcatgatccacacgcctcagcctcccaaagtgctgggattacaggtgtgagctgccgcacctggccaaagcaacctttttaacttttgcttggaatattgcaaatacgcatgagagtccctaagataacttaaggatccttgttttgtctttcagagtcaagaaaacttattttgaactatttacagcctttaataattaagtaaggtgccgggcaccgtggctcatgcctgcaaacccagtactttaggaggctaaggagggtggatcacctgaggttgggagtttaagaccagcctgaccaacttggagaaaccccatctctactaaaaatacaaaattagctgggtgtggtggtgcatgcctgtaatcccagatactcgggaagctaaggcaggagaattgcttgaacccaggaggtggaggttgcagagccaagatcacaccattgcactccagcctggcaacaagagcgaaactctgtctcaaaataaaataaaataaataattgcgtaaggtatatgcctgtgaacaaaatttggagcatgtttgtttttctctgcctggttcctctagaacgtggagactatctgtgagtactcttaacttatggcagtaaggttgtttgcatcagtgcaataagagtcaattttctggccgggtgccgtggctcacgcctgtaatcctagcactttgggaggccgaggtgggcagatcacaaggtcaggagatcgagaccatcctggttaacacggtgaaaccccgtctctactaaaaatacaaaaaaattagccaggtgtggtggcggtgcctgtagtcccagctactcaggaggctgaggcaggagaatggcgtgaacccgggaggcggagcttgcagtgagccgagatcgtgccactgcactccagcctaggcaacagagcaagactccgtctcaaaaaaaaaaaaaaaagagtcaattttctttgtcaacaggacacagttggaaaaactggttattttaccaaggtttcactgaaagggtgtgtttccctttaaggaatcaagcttgacatgcagacccaataaaaaccccttggagagaactggcctcatagttagtctacacagtccccacacagggttcctaacctatggtcagtaaagagtgtcactttctaacaggcctgggagctccaagtttatcttggaaccttaagaggagaggatcacccaactcacaggtatttgaggatacaaacccatagttgggctcggctttaaaggtcttatctgaaattccttgtgcaacaaagtttcatcaaagccaattcaaaaggcctgtgtagaaataaccattcctggccgggcacggtggctcatgcctgtaatcgcagcactttgggaagccaagctgggcaggtggatcacctgaggttgggagttcgagaccagcctgaccaatatggagaaatcctggactcttctaaaaatacaaaattagctgagcgtggcagtgcatgtctgtgaccccagctactcgggaggctgaggcaagagaacagcttgaacctgggaggcagaggttgcggtgagccaagattgccctgttgcactccagcctgggcaaatcatcaggccaagtataaaactaaagtttattctacaaacaacacacatggtcctatcataatttgtttttaccaaaaatgagacctggagaaattgtgtcccaaagcttatcatacatttgtcattaaatcctagtctcattaattgtttttaagctttttgcctacattttagactaaccctgtttattcctgtaaatcaagtggtgatctgcagcttggaagaaaaaaaaaggaatggagaatgtaaaaatctgaatcaatatactggttctgggcaattatcctataaattctgccaggtaataaaagtgagtaggggccaggcgcggtggctcacccctgtaatcccagcactttgggaggccgaggtgggtggatgacctgaggtaggagtttcagaccagcctgggcaacatggtgaaaccccatctctactaaacatacaaaaaaattatctgggcatggtggtgtgtgcctataatcccagctactaggaaggctgaggcaggaggatagcttaaacacaggaggtggaggttgcagtgagccgagatcgcgctattgccctccagcctgggtgagaaggcgagactccgtctttaaaaaaaaaaaaaaagaaaagcagggcgcggtggctcacgcctgtaatcccagcactttgggaggccaaggcgggtggatcacgaggtcaggagatcgagaccatcctggctaacatggtgaaaccctgtctctactaaaaatacaaaaaaattagctgggcgtggtggcgggcacctgtagtcccagctacttgggaggctgaggcaggagaatggcgtgaacccaggaggtggagcttgcagtgagctgagatcgcgccacggcactccagcctgggcgaaagagcaagactccgtctcaaaaaaaaaaaaaagtgagtagggtgcccatagcttggagatttctttgtttgggaaaataaaacaaaagaacttcataaacccccaaagggaaattctatatcttggcaagtaaaattttaagtggaaattatctactacaccacacttgtgggaattgctgtactcaccccactattttcaatagggttatacacggtagcaccttaaagctgaaatattggacagagtttccattgccgtagtattctgcttattatccttatagcagggatagtagttactaacgaaaaggaagcataaaagttactatcaccgaatctgccaggactttttactgggtttagtgatgcacttttaaatgaaacatgctgcttctggattaaaacctctactaaagtagaggaaaatctacaggtacttaaagatgaaatcaaaatcattgacaggctcagagaaaatgccggcttcagccccgggtggctacaatccctctttaatgaattcctgtcttctttatggaattggttaacccctttattaagccctgtcttgtttatatgtcttgtataaatatttggaccctgtatactcaatactgtaactcaaattgtttcctcttgcttagaagccatctaactccaaatggtgcaaactgaacaacccaaggacatgcccccacatgtgcctggcaacgtggctgcccccacatatccccacctgtgtaaaacatcattgcaccctgcatttgcatattaaaaggctagggtgggagggccagttttttcaaaggctacacgaataaaatgcctggtcaaaccagttccctgagccctatgcaaatcagacaccgcctcctccagcctactcataactggctggtatcccccgcacttgtggtctcctctgttggctttggagcccctctccctctgtctctgtacaggggagcttcttccttctttctgctcccttttttcttgcctattaaactctccactccttaaaaccactccatgtgtgtccatgtggctttatccaattcccacggaacaggagccctggtgttcctccactcatagaagctttattacttatatatatattctatatatccatcatgcatcctacaaagtgaaagcaactttttttttttgagatggagtctcactatgtaacccaggctggagtgcaatggcacaatctcggctcactgcaacctctgcctcctaggttcaagtgattctcccacctcagcctcccgagtagctgggactacaggcgcatgcaaccacagccagctaaattttgtatttttagtagagatggggtttcaccatgttggccaggctggtctcgaactcccgacctcgtgatccacccacctcggcctcccaaagtgctgggattacaggtgtgagccacaaagcccggccaaagtaacttattaattctgataatttttccctccctccctccctccctcactttcttccttccttccttcgttttgttttggtttttgagatggagtcttgctctatcgcccaggctggagtgcagtggcatgatctcggctcactcaacctcttcctcccaggtgcaagcgattctcctgcctcagccacctgagtagacgggattacaggcgtgtgccaccacactcgtttttgtttgtttgtttgtttgtttgtttgttttttgagacagagtctcgctctgtctccccagctggagtgcagtggcacaatctaggctcactgccagctccacctcccgggttcaaatcattctcatgcctcagcctccccagtagctgggactacaggtgcccaccaccatgcccggctaatgttttgtatttttagtagagacaggatttcactgtgttagctaggatggtctcgatctcctgacctcgtgatccacccgcctcggcctcccaaagtgttggaattacaggcgtgagtcactgcgcccagcctacacacactttttttttttttttaattagctgggcctggctgagcacggtggctcatgcctgtaatcccagcactttgggaggccaaggcgggcggatcaactgaggttgggagttcaagaccagactgactaacatggagaaaccccgtctctgaaaatacaaaattagccgggcatggtggcgcatgcctgtaatcccagctactccagaggctgaggcaggagaatggcttgaacctgggaggcggaggttgctgtgagctgagatggcgccattgcactccagcctgggcaacaaaagtgaaactctgtctcaaaaaaaaaaaaaaaaaaattagctgtgcctgtagtcctagctactgtggaggctgaagcaggaggactggttgagcccagttcaaggacgcagtgagctatgattgcaccactgtactccagtctgggcaacagagtgagatgttatctaaaaaaacagagtacaattcagtggtttttagtatattcacaaagttgtgcaatctatgccactatccagacattttaatcaacccaaaacgaaactctatgccgaatagtcactgcccattcccctctcttccctagccctgccaaccactaatctgtagggaccagccccacagggtcggtgggtctctccctgtgtgcggcgacgagagagtgtagaaataaagacacagacaaagagataagagaaaaggcagctgggcccggggggaccactaccaccaatgcccggagaccggtagtggccccgaatgtctggctgcgctgttatttattggatacaaggcagaaggggcagggtaaagaatgtgagtcacctccaatgataggtaaggtcacgtgggtcatgtgtccaccggacagggggcccttccctgcctggcagccgaggcagagaaggagaggagacagagagaaagagagcttatgccattatttctgcatatcagggactatttgtattttcactaatttactactgctatctagaaggcagagccaggtgtacaggatggaacatgaaggcggactaggagtgtgaccactgaagcacagcatcacagggagacggttaggcctctggataactgcgggcgagcctgactaatgtcaggccctccacaagaggtggaggagcagagtcttttctaaactcccccggggaaagggagacccctccccccactttcccggtctgctaagtagtgggtgttttcccttgacacttacgctaccgatggaccacagtccgcctggcaacgggcgtctgtcttcccagacgctgtcgtcaccactagaccaaggagacctctggtggctctgtccgggcataacagaaggctcgcactcttgtcttctggtcacacttcgctatgtcccctcagctcctatctctgtatggcctggtttttcctaggctatgattatagagcgaagattattataatattggaataaaaagtaattgctacaaactaatgattaatgatattcatatataatcatatctaagatctatatctggtataactattcttgttttatattttattatactggaacagctcgtgtcctctgtctcttgcctcggcgcctgggtggcttgtcgcccacactaatccactctcttaacccccctccctttttttttttttttttaagagataggggtctcattataatgttgcctaggctggcttcaaactcctgggctcaagtgatcctcttgcctcaacctcccaactagctgacacacgccaccacatcaggctttttctttttttttttttttgggacagaatctcattctgttcacccaggctggagtgcagtgatggtgtgatctcggctgcaacctccacctcccaggttcaagcgattctcgtgcttcagcctcccaagtagctgggatcacaggcatgtgcgccaccatgcccggctaattttctgtttttagtagagacggggtttctccatgttggtcaggctggtctcgaactcctgacctcaggtgatccgcctaccttggcctcccaaagtgctgggattacaggtgtgagtcactgtgcctggcctaattcttgtatttttagtagagacaaggtttctccatgttgcccagactggtctcaaactcctggcctcaagtgatcagtccaccttggccttgcaaagtgcaggggttacaggcatgagccactgcactcggtctatttttttttttttttttttttttgtagagacaagggtcttgctgccaggcgcggtggctcacacctgtaatcccagcactttgggaggccgaggtgggtggatcacgaggtcaggagatcgagaccatcctggctaacacagtgaaaccccgtctctactaaaaaatacaaaaaattagccaggcgtggtggcaggcacctgtagtccccgctactggggaggctgaggcaggagaatggcgtgaacctgggaggccgagccagcagtgagccgagattgcaccactgtactccagcctgggcgacaaagtgagactccgtctccaaaaaaaaaaaaaaaaagaaaagaagagacaagggtcttgctatgtggcccaggctggtcttgaactcctcttatcttggcctcccagagcgctgggattacaaggatgagccaccgcacctagatgctggctactttaagattttcactttatcagtggctttgagcaatttgattatgatgtgctttggtgtagtttcttgtgttagagaattgttgagcttcttggatgtgtagatttatgattttcatcaaatttggaaactgttaagctattagtccttaaggtattttttctgtgcccctctatctctcctttccttcaactccaattactcacatattagcctgcataaagttattccacagctcactgatgtggttttctttttactttccagacagggtctcactctcacccaggctgcagtgccgtggcacaatcataactcactgcaaccttcacctcctaggctcaagaaatcctcccatctcagcctcctaagtagctgggactacgggtgcacaccatcacacctggctaattttttcttttttgtagatatggagtctagctatgttgcccaggttggtctcaaactcctggcctcaagtgatcttcatgccttgacctcccaaaatgttgggattacaggtgtgagctactgtgcccagccatgtttttcattcttaaaattgttttttctgcctggccctgtggctcacgcctataatcccagcacttcggggggctgaggtgggtggatcatttgaggtcaggtgttcaagaccagcctggccaacatggtgaaaccctgtctctactaaaaatacaaaaattagccgagtgtggtggcacatgcctataatcccagctacttgagaggctgggccaggagaatcgcttgaacccaggagtcagagattgcagtgagccgagaccttgcgccagtgcactccagcctgggagacaagagtgacactccgtcttaaaaaaaaattgtttttttttctgtgaggatcacttgagcccaggaggtcaaggctgcagtgagccgagatggtgccactgcaccccagccagagtgagaccctgtctcaaaaaaaaaaattgttttttctctgcgtttcattttggatttcttttgctatgatttcaacttcactaaggcttccttctgcaatatctaatctactatcaaccctatttattgtacttttcatctctgacattgtaatcttttagatgcttgacttgggcctttgttttgtatctccttatcgctacttaattttttaacatatggcattcagttatagtaactattttaatgttttctgctcattgtaacatttgtgtcagttctaggttggtttccattaactgattattcttcttaatatggtcatgttttctgcctctttgcctgcctggtaatcttttcttaaaagtggggagcttttaaaccaatctcatcttctgggttaaaaagaatttttttgccattgaagttcatcttcatattccaatttttaaaaagcattctataaattttaatcatgtacaattatggggtacaccatgctgttatgatatatagatacagcatagagtaattgaatcaagctaattaacacgtttatcatcttaaatactcatcattttttcctgtctagctgcaactttgtactctttgaccaaagtcactccgtttcctccccacctccagtttctgctaactaccattctactctctgcttctattagttcaattatttcagattacacatttaagtgagaacatgccagaatgcggtatttgtctttctgggcctagttcatttcactcagcataatgtcctccagcttcatccatgtagttgcaaatcacaggatttgcttcttgcttctttttaaagttgaatggtattctattcaaatgtgtatatatacacattttctttatcttttctgtcttttcatctcttttttttttttttttttttttttttgagacagagtcttgctctgtcacccaggctggagtgcagtgacttggtcttggctcactgcaacctccgcccctctgggttcaaccaattctcgtgcctcagcctcccaagtagctggaattacaggagtgcaccgtaccatgcccggctaatttttgtatttttattagagacagagtttcaccctgttggccagactggtctcaaactcctggcctcaggtgatctgcccgcctcagcctcccaaagtgctgggattatacacgtgagccaccacgtccagcctgttttttgtttgtttgttttttgtttttgagatggagtctcactctgtcagccaggctggaatgctgtggtgcaatctcggctcactgcagcctctgcctctcagcttcaagcgattctcttgcctcagcctcccaagtaactgggattacagacgcctgccaccatgcccagctaatttttgtatttttagtagagatgggggtttcaccatgttggtcaggctgctctcaaactccttacctcaagtaatctgcctgctttggtctcccaaagtgttgggattacaggcgtgagccacagcgcctggccacattttctttatcctttcatctgctgatggatgcttaggttgatgtcatgatttgcctgttgtaaataacactgcagtgaacctggaaatgcagatatctctgacacactgatttttcagttcctttggatatacacccagaagtgggattgctggatcatttggtaagtctacttttagttttttcgttttgttgttgttgttgttgttgttttaaatgagtctggctctatcacccaggctggagtgcagtggcactatcttggctcactgcaaacctccacctcttccctgctcatgcaatccttccacctcagcctccctagtagctggaactatggtgcatgccaccatgcctggctaatttttgtattttttgcagagacgggggttttaccatgatgtccaggctggtctcaaactcctgggctcaagtgatctgtccacttcagcctcccaaaagtgctgggattacagatgcaagccaccacgcccagcctatattttgaggaacttccatataattttccagaatgactgtaataatttacattcccacgaacggtgggtaagggttcccttttctccatatcttcaccaacaccagcaccaacaggtgatatctcatcgtgcttttaatttgcgttttcctggtggttagtgctgttgaacattttttcatatatttgttggtcatttctgtgtcttttttttttttaatatctgttcaggtcctttgcccattttaaatcagcttatttgtttttttcactctgagttttttgagtttcttatatattttgggtattaacaccttattggatgtattgcttacaaatgttttctcccaatctgtaagttattacttcattctgttaattttttccttatgcttggtaatccttgattgcttatcagacattgtaaattttaccttgtagaacaccaaatatttgtgtaatctttatgatttgttagacaggtccagattaatgctcagtgtaggcttaatttttttttttttttttttttttttagatagagtctcaccgttgcccaggctggagggcagttgtgccattttggtgcactgcagcctctgcctctggagttcaactgattctcctgcctcagcctcctgagtagctgggactagaggcacacgccaccatgcctggctaatttttgtatttttagtagagagtgggttacaccctgttggccaggctgctcttgaactcctggcctcaagtgatctgcccaccttggcctcccacagtgcgattacaggtgtgagccaccgtgcctgcccggcctttttaagagatgtggtcttgctgtgttgcctgggctggtctcaaagtcctgacctcaagtgatccacccatctcagcctcccacagtgctgggattacaggcatgagccactgcaccggaagtctaggtttaattattccccattactgagacaagatcttcctgagcactctaccccatgcctagcgaatgatcagtttttccagctggccagtgggaagaggtcctggccctacctcgtgtgaatcttgggcgttgtttcctcgaatcctttcagctggttctttccctggccttggagagtttcttcacacacatgtgctgattagttctttgctgaatcctctgaagtcctctggggtactctctctgtgcacctctgtcttgtaggtgttccattatctaagctctagctgctgtggtctcctcggactcagccactccatttcctcaactctgcgaatcctctgggctgcaacaacccacatcccccttgccctgccccacactttggaaacgctctcgaagcagtaaactgcacagtcctaaaaggactgttgatgtcctttctctctgggatttcattgcttttgttactttctctcattgcttgatgttcagcgttttgaacactgttgttccatgtattgggtctgtttttgtcactgtggtggtggtgattgtttcagacaggagggcggacccagcccacgtgactccatcttggctggaagcaggaatctcgggatcagtggtttcaaagctcctcaggtgattccaggggacgctgaggtgaggaccacttgcagagactcctctgcttgaaatatctctcaatcaaatggaatcttcttttgttgttcccaccccttcattttctctgttctctctttctgagttttttctttgtttttgttttttgagacaaggtcatgctgtgttgcccaggatggagtgcagtggtgccatcacggctcactgtagcctcaacctcccgggctcaaacaatcctcctgccccagcctcacgagcagctgggaccacaggcccataccatcacgtccagctatgttctctctttctggaacttctgttaaacaaatatggattgaattgattctccatctcttttctttcatattttcctttcttttctttcttttttgttggcattttgctctacatcctgagaggtgtttcaaaacttttccacccgtaccttcctttgattaattttttatttaacttaattaattaattaatttttgagacatggtctcactctgtcacccaggctggagtgcagtggtgcaatctcagctcactgcagactcaacctcctgggctcaagtgatcctcctacctcagcctcctgagtagctgggagtacagatgcactccaccatgcccggctaattattttattttttgtagagatggggttttgccatgtttcccaggctgtgatggatttttaaatttggtccgtcgtatttgtgacttccagaactttgtcttgttctccaattgcagcatcttcctggaagcctcttcttggttcgtggtgcattatcttattcattcctttcctccagggctagtgttctgctattcttcctttcttttttttttttgagacagagtcttgctctgttgcccaggctggagcacagtggcgtgatctcagctcactgcaagctccagctcctgggttcacgccattcttctgcctcagcctcccgagtagctgggactacaggtgcctgccactacgcccggctaatttttttgtattttcagtagacatggagtttcaccatgttagccaggatggtcttgatctcctgacctcatgatccacccgccttagccttccaaagtgctgggattacaggcatgagccattgcgcccaggctttttttttttttttttttttttttttgagatggagttttgctcttgttgcccaggctggagtgccacctgcagcccagtgatcttggctcactgcaacctctgcctcctaggttcacgcaattttcgtgcctcagcctcccgagtagctgggattacagtcatgtgccaccatgcccggctaattttatatttttactagagatggggtttcaccatgttggccaggctggtctcgaattccagacctcaggtgatccaccctcctcagcctcccagtaagccactgcacccaaccatctgctattcatcttaatcctctctggtggcaccgaaatgaagaggagacccatgtggatctccctgcagccgggtgagtctggttccacaggaggccttttcctgaactggctgcaggctccgcgggcaggtctgttaattggttaaaatgcttcattcagttaggtgggttttgttcccttctccccacccagaggacatttgggaatgtcgggagatatttttggttatggcagctagggggatccttctgacacctagtggatagaggccagaaatgccactaagtatcctaggacatgcaggagagcctctcaacgattaagaatcagctgtcccaacatgttaatagcacataggtcggagagacaccctgatttaaggccatctgagtacaggctccccagctctcaccaccaaaggccaagataaggagggtccctctacagccacttcagggaacttccaagggagcttgttcaattatgtttatttattttatttatttattttttttgagacggagtcttgctctgttgcccaggctggagtgcaacctccacctcccaggttcaaacgattctcctgcctcagcctcccaagtagctgggattacaggcacctgccaccacacccagataatttttgtattttttgtagagaaggggtttcatcacgttgcccaggctggtcttgaatgccatgaccgcccccagttgtgcttagaagataccgccaacaggccgggtgcggtggctcatgccttaatcccagtactttgggaggccgaggcagctggatcacgaggtcaggagttcgagcctggccaagatggtgaaaccccgtctctactaaaaataccaaaattggccaggcatggtagctcacgcctgtaatcccagcactttgggaggccaaggtgggtggatcatgaggtcaggagatcaagaccatcctagctaacacggtgaaaccccgtctcaaaaatacaaaaagttagccaagcgtggtggcacacacctgtagtcccagctactcagaaggctgaggcaggagaatcgcttgaacccaggaggtggaggttgcagtgagacaaggtcgtaccactgcactccagcctgggcggcagtgtgagactccatctcaaaataaataaataaataaataaaatattaaaacataaaaatacaaaaattagccaggcaaggtggcgagtacctgtaatcccagctactcaggaagctgaggcaggggaatcacttgaacctgggaggtggaggttgcagtgagccgagatcacgccactgcactctagcctgggtgacagagcaagactctgtctccaaaaaaaaaaaaaaaagaagacacctccagctgacagatcatgagccacatgtggcccaggcttgtcttgtttggcttttatagggagatagatttatatatatatacatatatatatatgttgttctgtagtgttgcgtcatgagatattgaaaaacacacataactttttttaaaatttgttctgggccaggcgtgtaatcccagtaatttgtgcagctgagatgggaggatcgcttgatctcaggagttcaagaccaacctgtgtgacacagtgagacactcatctctacaaaaaattaaaaattactggggcatggtttcgtgcacctgtggtcccagctgagatgggagaattgcttgagcacacgaggtcaaggctgcagtgagccaagatcgcaccgctgcactccagcctgggcgacagagcaagatcctgtctcaaaacaaacaaaaacaaaagtaaaactacaatgtgaatgcaagttttctcagaatatacatcctttaatattttgatctttgaattttcaatcactatctaccacagaatgttccctttccaaattacaactaatttataactcagtaaggaacactctgggacaagttcttttttttctttcttttttccaactctggatacagattggcagacagcagtcttgagagcttgttgggagggtctagcaggggagcacagctacttgtatgcccttgaccgaagactggtccttgtctatcggggatggttgtcctctttaacggagtgcacagcttcaggaggttgcacatggagtagtgagggaggaaggggacacccacctagccagccaggtcagctgaatcaaccctggcgatcagtggggtaacatgttgcagccagatcgccctcacatccaggcagcagtctttagtgaagtgctaacattgttcaacagagaaatccaatagctaggttggaggtgggcagagaaagggaagttataaaactcaccaggctgggcgcagtggctcatgcctgtaatcccagcactttgggaggccgaggcgggcagatcatgaggtcaggagatcgagaccatcctggctaacacggtgaaaccccatctctactaaaaatacaaaaaattagccaggcgtagtggccggcacctgtagtcccagctacttgggaggctgaggcaggagaatggcgtgaacccgggaggcagagcttgcagtgagctgagatcgcaccactgcactccagcctgggcgacagagcgagactccatctcaaaagaaaaaaaacaacaacaaaaaaactcaccaaagatttggctaacatcacatcaaaaggagtattctcattttacttaaaatgcccacatttgtgtttgttttgttttgttttgagacagagtttcactcttgttgcccaggctggagtacaatggtgcgatcttggttcactacaacctccgcctgcccggttgaagtgattctcctgcctcagcctgctgagtagctgggattacagatgtgccccaccatgcccggctaattttttgtgtttttagtagagatggggtttcaccatgttggccaggttggtcttgaactcctcacctcaggtgatctgcttgcctcagcctcccaaagtgctgggaatccaggcgtgagccaccacacccgaccccacatttgtttttatgatagaatgttttcataatttattatattactaagttgtgttttagatttttcagtttcaagtttggtttctaaaataaatgagtacaaaccacaagctcagtttctcctgaaactctcacagcctgcttctgacgtcagatgtgtgtgggttgcacactgcgttaatccattctcacactgctataaagaaatacctgagactgggtaatttataaagaaaagaggtttcattggctcacggttctgcaggttgtaaagaaagcatctgctcagcttccggggaggcctcaggaaacttacagttatgacagaaggtaaaggggaagcaggcacgtcttacgtggccagagcaggaacaagagagagagtgaaggggtaggtgtcacacacacattttttttttttttttgagatggaattttgctcttgtcacccaggctggtgtgcaatggcacaatctcggctcactgcaacctccgcctcccagattcaagcaattctcctatctcggcctcccaggtagctgggtttacaggcttgtgccaccatgcctggctaatttttttttttttttttagatggagtctcactccgtctcccaggctggagtacagtggctcgatctcggctcactgcaacctctgcctcccagattcaagtgattctcctgcctcagcctcctgagtagctgggtttacaggggcgcaccaccacacccggctaatttttttattttcagtagagacggggcttcaccatgttggtcaggctggtcttgaattcctgacctcgtgatccacccgcctcggcctcccaaagtactgggataacaggcgtgagccactgcgctcagccaattttttgtatttttagtagagctggggtttcaccatgttggtcagctggtctcaaactccagacctcaggtgattcacctgtctcggcctcccaaagtgctgggattacaggcatgagccaccgcacccggccagtttcacacacttttaaaccaccagatctcacaagaactccctctcacgacgacagaaccaagggggatggtgttaaaccatgttaaatcatgagaaaccaccctgacaatttaatcaccccccaccaggcatcagctccaacactagggtttacaatttgacatgagatttgggcagggacacagatccaaaccatatcacacaccaaacaagcaatcagttctactgcagacaccagctgggtgtcctctgatttttttttttttttttgagacggagtctcactgtcgtccagtgagattgcagtggtgcaatcttggctcactgcaacccctgcctcccgggttcaagtgattcctctgcctcagcctccggagtacctggggttacaggtgcctgccaccacgcccagctaattttttgtgtttttggtacagacggagtttcaccgtattagccaggatggtctcgatctcctgaccttgtgatctgccctcctcggccacccaaagtgctgggattacagtcttgagccaccgcgcccggccatgtccactgatttaatccaattataacatcatctacctggagatagcgtcacatctcacggggtgagggctgcatcccacaagactgcccctgacttccgatgccaattgcaagccccaggtttttttacctgcacttctaaccaactggctaataaatcagggttctcccggccctgcccttgggtgacattaacttgctagagtggctcacagaactcagagaaacatgtttaccagtttggttattataaaggatatttcaaaggccaggcacggtggcttatgcctgtaaacccagcactttgggaggtcgagacgggcagatcacttgaggtcaggagtttgagaccagcctgggcaacatggtaaaacccccatctctacaaaaaatacaaaaattagccaggcatggtggcatgcactgtaattccagctactcgggaggctcaggagtttgagaccagcctgactaacatggtgaaaccccgtccctactaaaaaatacagaaattagccgggcgtggtggcatgcgcctgtaatcccagatacttgggaggccaaggcatgagaatcgcttgaacccaggaggcagagtttgcagtgagctaagatcacaccactgcactccagcctgggtgacagagcaagactctgtctcaaaacaacaacaacaaagaaaaccaaagtgatccacccaccttggactcccaaagtgctgggattatagacatgagccaccatgccctgcctttttttttttttttcagacaggatctctcgctctgttacccaggctgtagtgaaatagtgtgataatgtgatcacagcttcctgcatccttgaccgcccccagcctcaagtgttccttccacctcagcctcctgagtggctgggactacaggtgaccgccatcatgcctggctaatttttgttttttctttttttagagatggggttttgccatgttgtccaggttggtcttgaactcctgggctcaagtgatcctcctcccttggcctctcaaagtgctgagattacaggctatgagcctctgtgcctggcccctaaactttttccaacccaccattccaccatgctccgtgtatcagctctccatactttatgacttcattgctttagtcactgttctgctacttgcagcctagggcattcctaatgacacatggtccacattagactttacagatagcctcattttctactagttttgcctatgaggaagacagccctagaaagtgacagctagattgagacctaaagagtaagaattagccaagatgaagtagtgggagggaggaagatggatgttgcaaaaggaagggagtgtttgttgaaatgatcagaagttggaaaaatcttttaagcatttttcttttctttagagatgggttctctgtcacccacattggagtgtagtggtatggtcatagctcagtgtagccttgaactcctgacctcaagggatcctcctcttcagcctcctggaattacaggcatgagccatcatgcttggctaatttatttttaaattttttgtatagacctggccacgtgtgagggctcatacctgtaatcccagcattttgggaggcctaggtgggtggatcatctgaggtcaggagttggagaccagcctggccaacatggagaaaccctgtctgtactgaaaatacaaaaatttgctgggtgtgctggtgcacacctataattccagctatttgggaggctgaggcaggagaattgcttgaactcaggatgtggaggctgcagtgagccaagattgcaccactgcactccagcctgggtgacagaccaatactctgtctcaaaaaataaaaataaaaataaattaaataaataaaaataaattctttgtagagaccgggtcttgctacattgcctaggctggtctcgaactcccagtctcaagcaatcctctcacttcagcctcccaagtagctgggattacaggagtgagccaccacatccgacccttttaagcatttttttttttttttttttggcaggcttactccaggtgcaatgtggaaaatagagacaggggaacatttaagcgcagtttaggagcaatgagtggagcagaaccaggatggaagaagtaagcatgaggagaagcaggcagaagtcaggggtgtttggaggtgctgatggggggcagaaaggagcctaggagaaagaagagtattaggcttggtgggggtggtcatgcatcctaaaataattttgaggtcttcacagggggatattgaagtggctgttagagagatagggtttgaagtcaggagagagacataggttaagacataggtttgggttcatgttacagagacccaggacgacagtgatttatacaaaagaaagtgttagttctctgtcgtgtaattacactgaggcaggcagttcaggtgtcctgtgctggctgcagggattcaagctccttccatctcctggctcagccaaccctggcatgctgccgttgtccatgatatctcaccatcatgtctggattctaaatagcaggagagagaaagaggagtggggaagaggagccagaaccagttgcatggatgcccttagccacaagggggtctgggaaatgcagcttttcctctgggtggccacaagcccagttaaaaataatggtgctggcaacgtgcatggcacacggctggaatcccagcactttgggaggctgaggcaggtggatcacttgagcccaggagctcaacaccagcctggccaacatagtgggaccccatctctacaagaaatacaaaaaatagccaggtgtcatggcacatgtctgtagtcccagctacttggaaggctgacacaggaggattacctgaaagtgaggaggtcaaggctgcagtgagctgtgattgcaccactgcactcgtcttggcaacagagcaagactctgtttcaaaaaagaaagaaaaaaagaagaggttgtattagtccattctcatgctattaataaagacatacccgagactgggtaatttataaaggaaagaggtttaattgactcacaattaagtatggctggggaggcatcaggaaacttatacagtcatggcagaaggggaagcaaaaacatccttcttcatgtggcggcagcaaggaaaagtgctgagccaaaggagcaaaagtcccttataaagccatcagatcttgtgacaactttatcaccagaacagcatggaggtaaccaccctcatgattcaattgcctcctacgacacgtggggatacagccaaaccatatcagaggtagtgctattcctttaaaataatgcgagaatagatctaggaggaccacatctgccaccgctggagatggagacatggggaacatcagggtatgagatagtaattggggccaggcgcagttggctcacgcctgtatcccagcactttgggaggctgaggcgggtggatcacttgaactcaggagttcaagaccagcctgaccaacatggtgcaaccccatctctagtaaaaaaaaatacaaaattaggctgggcgcggtggctcatgcctggaatcccagcacttagggaggatgaggtggacggatcacctgaggtccggagttgaagaccagtctggccaacatggtgaaaccccgtctgtactaaaaatataaaaattagccgggcatggtggtggatgcctgtaatctcagctacttgggaggcagaggcaggagaatcgctcaaacctgggaggcggagattgcagtgagctgagatcatgccattgcactccagcttgggcgacaaaagcgagactccgtctcaaaaaaaaaaaataaaatagctggacatggtagtgtgcgcttgtaatcccagagacttgggaggctgaggcaggagaattgcttgagcccaggaggcggaggttgcagtgaactgagatcatgccattgtactccagcttgggcaacaagagtgaaactccgtctcaaaaaaaaagagatagcaattggagccttgggcctaggtgaaatttcccagaaggagtgcagagggaggggaaaagcagcccaggactgacctttgagaaggcatgccgccagcaaagagagtcagagagcacggctgggtagcggggagggaaagcaggtgtgtgtaaagccacagagccatggggagagaacatttccagaagtgtccagtgctgtctgcaggaggcttgaaagtgtcctttgattaaaacagcaggtcatgattttgatggcagtcgtttctgtagagtgctggaagcccatggaagcctgcaaccagttgcagagggaggggaagatgagaaagtgtagactgctaggacagacggctcttcccagacgtttggctgtgaaggaggtgagaagtcgtgctgtgtgtgaggggtagagaatgagttgttggagctggacatgactcacccctgtaatccctgcactttgggaggctgaggagggaggatcacttaaggctaggagtttgagaccagcctgggcaacatggtgagaccctatgcctacaaaagtcaaaatactagttagatctggtggcatgtgcctgtaaccccaggtacttgggaggccaaggcagaaagatggcttgagcccaggagattgaggctgcagtgagccgtgactgcaccactgcactccagcctgggtgacagagtgagaccctatctcagaaaaaagaaaaaaaaaaaaaaagagttgttggttggctggttgttttaaggtgggagagatgtcaacttatttatatggggaaatagccttttgggtgatagtgtgaatggaataacctgacaagcatgtcctcaccactatgcatctagaagcgctgcataaaaccaaacaaacatcctttaaaacatgcagcttagttgcaaaaaagaaagggaaatccccaggaggcacgaagaggaaactgaacactagagctgtgcaacttgctgggtggctgtgatcttggcattgaagggcctagggctttacacctacctagagattggagataaggccttgtctggggaactgaaaacataaacactaatagaaagcttgtacccttaaggggtgacatccttggtgaaagagtaaactaggaaaaaaatctgcctccagttcagggagcataaaaggaccttgtctgtttcactctgagatttggtgacaataaatggtctcttttgagaattcataaccaaaggcttggcctcacttggacttggggttcaagtttacatcatctgcatggtctgggaagcccaaatgtcaacaaataatatagtccaggccaggtgtggtagctcgtgcctataatcccagcactttgggaggctgaggtgggaggatcacctgaggttaggatttcaagaccagcctggccaacatggtgaaactacgtatctactaaaaatacaaaaattagccgggcatgttggcaggagcctgtaatcctagatactcgggaggctgaggcaggagacctcgggaggtggaggttgcttgaccctgggaggtggaggttgcagtgagctgagatcgcaccactgcactccagcctgtgcaacagagcaagactctgtctcaaaataataataataataaataataataataataataataacaatgtagtccagggttggtaacacccatgaagagctcttggcagaagcagatgtgaaacctctttgaaccttggtgggcatgtgcattcccactgataacaccctgctgaagctgaattcacagctcaaaattacaaaacataagaggaaacaatcttcatgaatgacagtaagcagacacagcatatagcaggattagctccaactccagaactccagagaatagcattatttggcaaagaaccatacagcaagtgtggtttaaatttctaaagatataaaagaagacatcaatatgagaaagaaataagatggtgttaaaaatgagtgggattccggtcaatgaatgcgtctaaaaaaaaaagtgagcaggagaggtttaaagtaaaaagaagaaacagtaaaatgaatgtgtctgttaatctatgaacttattcattccccattcattaggctcctatagtgttttagaccatgttctgggtctggaaatataaagatgactctgcagatagcaagttagactctgcctcaggaagatcgcatgcagaaatccatgtatcaatgcatccatttatctatacatccactcatccacacatccattctcttcacctatccattctcccatccatccatccatccatccatctattcatccatccatctgtccgtctgtccatctatccatccatccatttattcatccatccatccatccattcatccatccatctagtcttccatccattcatttatttatccatccatccatccatccatccatccaaccgtctttcattttactcactgtgggggaaagaaagagagatctgactgttactgtgtctctgtagaaagaagaagacataagaaactccattttgttctgtactaagaaaaattctgccttgagatgctgttaatctgtaaccctagtcccaaccctgtgctcgcagaaacatgtgctgtgttgactcaaggtttaatggatttagggctgtgcaggatgcaccttgttaaaaatgtgtttgcaggcaatatgcctggtaaaagtcattgccattctccattatcgagtatctagggacagaatgcactgcggaaggctgcagggacctctgcccaagaaagcctgggtattgtccaaggtttctccccactgagacagcctgagatatggccttgtgggaaggggaagacctgactgtcccccagcccaacaccgtaaagggtctgtgctgaggaggattagtgaaagaggaaggcctctttgccgttgagataagaggaaggcatctgtgtcctgctcgtccctgggaacggaatgtctcggtgtaaggcccgatcatacattctatttactgagataggagaaaactaccttatggctggaggtgagacatgctggcggcaatactgctctttactgctctgagatgtttgtgtaaagtcaaacataaatctgacctacgtgcacatcgaggcacagcacgtttccttaaacttatttatgacacagagacctttgctcacgttttcctgctgaccctctccctaccattaccctatagtcctgccatatccgcctcactgagatagtagagatagtgatcaataaatactaagggaactcagagaccagtgcccgcacaggtcctccgtatgctgagcgctggtcccctaggcccactgttctctctctatactttgtctctgcatcttatttcttttctcagtctcttgccccacctgacaagaaatacccacaggtgtggaggggctggcccccttcactcattctcaaatgtcacagctagaaaagtcccaatagaacatcttgttcaactttcagctgtctttttgtacatgaaaaaagcacatgaggccccataatacaaaactctgttttctgaagtctctaagtgaataaggtgatggaggcagatcatgaactggggccttgtccctgcatttcttccacactgcagtgcctttcctgaacccatggcatggaagcatctgacctctgaacacctgcctgtatcttctgtttctctcaggtctgttcactcctcgtgggcagagtccccacaacccagtgctgtcaactgatggtgatgataaggaatgtcattacccagctcatgagtgatagagatgggacagggccctggtctctccctggtgtcagttttgtgtccatatcttagctcacccctacctttgttccctactctgccgctagagagactgtgagctccttgagggcagggcccaggtcttattcctcccctcccagtgcccagctcagaaacagtgcttaggatgctggccagtgactacacctgggagaagagactggactaggctctcggtccctctgcctggggtttctggctgctctgtcaacttccaacatcccaaaaatcagaggggaggtcaagggattggatgagaggctccaagtgctccttagcccactgtgcagggagaagtgagtgtttcctggctgtgggtgaacttcgtggacagcattaaacaacacagcatcccgccccctgtgcggggctgtctgtctgccttggcacttccagaaggtctcattgtggtgctagagtatctaacactttctgacttgcagatcaacattcccttttcttgttaacaaagagcagtgccgggcgcggtggctcacacctgtaatcccagcactttgggaggctgaagcgggcagatcatgaggtcaggagttcgagaccagcctggccagcatggtaaaaccctgtctctactaaaaatacaaaaattagccaggcatggtggcaggcgcctgtaatcccagctacttgggaagctgaggcaggagaatcgcttaaacccagaggcggaggttgcagtgagcggagatcgcgccatcacactgcagcctgggcaacagagcgagactccgtctcaaaaacaacaacaaaaacaaagagcagagttttaggtcaatgcttccagcagggaacagaatttagatcttaacaattttgtttacattgtatttattttcatgttttaccttctattgatggcaaatgagactggttttccatttacagaagtgatacaaaagattcctgttgcaataatttcattaagtgaataatgagccaatttaaagaaaaatataaagcaaataattgtacagatggtaaactaatatggcaaaatcactaatattcaaggctgaagtttggccgggcatggtggctcatggctgtaatcccaacactctgagagatggggatgagtggctctctcgagcccaggaattaaagaccagcctgggcaacatagcaagaccctgtctctaaaaaaaaaaaatagccaggtgtggtggtacatgcctgtagttccacctactagggagactgaggtgggaggatcacttaagcccaggagttcaaggccgcagtgagctgagattgtgccactgtagtccagcctgggcaacagagtgagaccctgtttcaaaaacaaaaaaaagtggccgggtgcagtgctcatacctgtaatcccagcattttgggaggctaaggctgctggatcacttgagcccaggagttggaaacctgcccaggcagtatggtgagaccgtgtctctacaaaaaaaatacaaaaattagctgggcgtggtggtatgcacctgcagtcccagctattctagaggttgaggtgggaggatcgcttgagcctaggagttcgaggctgtagtgagttgagattgtgccactgcactccagtctgggtgacagagttgagattctgtctcaaaaaaaaaaaaaaaaaaaaaaaaaagacaaagtttggaaaattaaacccccagggaaatggaaactacatctgctgctcacccacctgcctgcctctcctaaagggaagattgggtacttggggtcccatttctgtagggtggagcattataagtaagcctagcttgtggcaaatctgtctctctggacactccagcaagctggaagggacgatgatcagaggtcacagtttgggagttgccctgctctaggacaacgctcctctccacattggatgaaactcagtttcccctggccatggccttcctcaccatggagtggtgagggtccgaggctgagacgtgtgcagatggaggagaatgggcagaggagcctgtgggttttctctgactctaggtccccactccagcaagacagcgccgctgcagcttggcccagcaagttcctccttgcagtttgggggtcaaagccacagttcatatgaaacaaaatgttcctctgcctggtctggtcctctctttgtgtattttcctagaggacctcacagtgggtgagtggccaaggagaacaggatttgtggctctgggaaactggattcctgtcatctcctgccagctgtcatcgccacaccgaggctgttcagcaccgcaggacccgttctctttggtattggtggcttcggtaaacactgaaagaaggtggaggtggctggtcgatgccatttcctgactatctagtaccttgggttcttcatctggatgcgatcttgaaggcttctggcctggcattggctccacccccaggtctctgagccacagcccaggtagctgagcagaggcactgctgggcttcccctagtccacatagcctggccaccacccagacccggggagggggactccaggtggaaggagcctgggaagggcatcttcgctggggcagtctcaatcctaatgctggatcctggggtccccggtcccactgaggcaaggcctgcctcggggatctctggggaaccctggggattcagaaccccacactggtccggccttcacgcttccagaaagctgagatctgctccaaggtgacccgtggctggaggccccactcaggatccgggctccctggccgctgcctcctggcctgggggctcccaaactggacgctggcctctggcctctgctcgggttcagcccagctcaccaggcctgtggcggggggcctcccctcccagggctggggcccccagaaggtgctccgggctgggacctccagtacggtctgggggcccaagttgctgggagcagaatttggggctgagggggcaggtggggctgttgctcgggcctccaaagtgcccacctgggtgggaggctcaggggcccgatctgtcagcagggggaccgcagagccataccagtcctcagagcgctctcgggcggtgcccatgggctcaatccacagctctcctcctgggcgccacaccagggtgggtgcacggtggctggggtctgggcggagagcacggcggaacaggcgttcagccaacacagcggtggtgaggatgaagagcgcagccagggtggccaggaccagcatgatggggatgcagggcccacagggcagtgagggccatggggctgcttcccatgcggggggcccctccacgcgcccagagggcggctctggagtcaacggcatctgagagacacaggggtgagaagaggaagtaaatgaggcagagggggcacaaccaagatgagagagaggcagcaggtgtccaggaaagcctgggagaagggctgggcatgggggctcatgcctggaatcccagcactttgagaggtcgaggcgggaggatcacttgagcccaggagttcaagaccagcctggacacacagtgaaacctcatctctaaaaataatttaaaaactagctgggtgtggtggctcacacctgtagtcccagctacacaggaagctgaggtgggaggattacttgagcccaggagtttgaagctgcagtgaccccagattgcaccactgtcctccagcctgggcaatagagcaagaccctttctcaaaaatgaaaaagaacattctggagagacagagaagcaagagggaccagaaagggtaagcgtgagccaggtggggtgggaggacaggcagcctacctcggggcacagccaggccctcctgcctggctctccaggcctttccagaatccccatttccctcccagaccccagggtgcctcagacaagaaaggtctcaagggcttctttcctccccactcggccccctcaagtcttgctcagacctagagaggaagtggtgggtgaagaaatgagaacctcccctcccactggctcccctgcgtgtgtctcccccaccgcctgccgccagcacctccgctggccccttgaggctccttcgcccctcaccattctcctcggacttgatcttgctctcataggctccacggaatctgctgccgggccgggccgggccaggcctccggaggcgcctctgcacccctcctgggctccccagctttgcccaggctctggcctgtctctatctctcgtttgtctctgcacacctctctgtcccccacatcctccatctgcagggggcctcctgcacccctcaactcaccttgggtcagtccctgggctcctctccctcctagagccactcttcctggtgctggactaagaggtgcaggcttggagggtgcagggcggtccgcctctcagacgtagaggcccggcctcggatgaaggcggaagggagggcaccgcctgttgctgggcaactgtgccccaactcgtctgcccctggggagtgtttgtttccaaagcaacccaaggggatgtggtcactgcggtgaggaggcttttcctggggtaaggtggggctggaatgggcaatggttctgttgaacttagtgtcaccccatagccaggccctgagccccagaacattcaccgaaaagctgagaaagaggacgccggggccaggcacagtggctcacccctgtaatcccagcattttgggaggtcaaggtgggcaagtcacctgaggtcaggagttcgagaccagcctgccaacatggcgaaaccccatctctactgaaaaatacaaaaattagctgggcatggtgacgggcacttgtaatctcagctgctcaggcggctgaggcagggagaatcgcttgaacccgggactcggaggttgcagtgagctgagatcgtgccaccacactccagcctgggcaacagagtgagactccgtcttaaaaaaaaagaaaagaaaagaaaagaaaaagaaataggacactgggactttagcccgtacattcccagagaaccatggtgcctcccccgttcctcctgggaggatgccccaccccatcctgccttgtcttatccacggtgcctccccagatctgctcctgccatgcagcccccacaggcaccccctgcttggccagcttgcttcacaccttttttttttttttctggtagagatgggctcttgctatgttgcccaggctggtctcaagctcctggcctcaagagatcctcctgcctcagcctcccaaagtgctgggattacaggtgtgagctaccacactggcccctgcctcatacttttaattaacataagtctctctctcttcagaccatttagcccccattttggttggaaaatatcagtgaggtgaggcttgggtaacaaaaatgtcaagcctctgagaggagtccagggtataaaaacaggcgtgggcctgtttccaaaaccctgaccatcctcatgtctgtccctctttcctgctgctgagggtgggaggagcctggagcagagtgtgacaagatgtcatcaggctctggagtccaggtgactttctgagattctctagtttgactcatccacagatgacaaaagtaaggcttaaagaaaagagatttcatgaccaaagtcgcatgaccaatgtatgtgtgggtgagcatgtagtggccagggtggtggaagaatagatagaaatccctgggctgggcgaggtggctcatgcctgtaatcccagcactttgggagaccgaggcgggtggatcacctgaggtcaggagtttgggagcagcctggccaacatggcaaaaccccgtctctactaaaaatacaaaaattagccgggcgtggtgccgcacgcctatgaccccaactactcaggaggctgaggcaggagaatcgcttgaacccggtgcagtgagccgagatcgtgccattccactccagcctgggcaacagagcgagactctgtctcaaaataaataaattaaataaataaatgaatgaaaagacagtctccgtcagactgccccatcctggtggttttgagccctgctgggaggagctggagatggagagtccgggggaaaccgcctttgcaaagaaagagatctaacttaactgactccaccttgcttctaacctccaagctgtctttgtttattcctgggcgtaggctgaactaactttgggagaaacttagtttgtagtttatagtttaaacaaagacagtaacagccctttcccaaagcagaccttcttgcctggggactagactaacactagccataggattagaaattatggtttaggagtcatgcagctggaggctacaagattctgaccctccctaaactgctcctaacatcagtgcttgagatattttgcagaccctgcacttgatggatcagctggcaccacccagatcaataaactggctcatctgatcttgtggcccccacccagaactgactctgcaagaagacagctctgactcctgatgatttcatctctgaccaatctgcactcccagatcccagcactttgggaggaccagacaggcagatcacaaggtcaggatgagaggtgacagcgtgctggcagccctcactcactctgggcgcctcctcggcctccacgccaactctccctgcgcttgaggagcccttcagcccgccgctgcactgtgggagcccctctctgggctggccgaggcgggagcccgctccctctgcttgccagaggtgtggagggagaggcgcggacgggaactggggctgcgggccacgctcgagggccagcatgagttccgggtgggcgtgggctcggtgggccccgcactcagagaggccggctggcgccattggccccaggcagtgaggggcttagcacccagaccagcagctgcagagggtgcgccaggtcccccagcagtgccagcccacaggtgcacttgaattctcgcaggcctcagctgcctccccacggggcagggcttgggacctgcagcccgccatgcccaagcgtccccctgcctgggctcctgcaccgccccctgctctgcggggcctggtcccatcaaccgcccaagggctgaggagtgcaggcacaggattggtgggcagctccacctgcagcccaggtgctaggtccactaggtgaagccagctgggctcttgagtctagtgggcacttggagaacctttatgtctagctaagggattgtaaatacaccaatcagcactctgtgtctagctcaaggtttgtaaacacaccaatcagcaccctgtcaaaatggaccaatcagctctctataaaacagaccagttggctctctgtaaaatgggccaatcagcaggatgtgggtggggccagataaggcaataaaagcaggctgccagagccagcagtggcaactcggcgtacccttccacataggaagctttgttcttttgatctttccaataaatcttgctgctgcttatcctgggtctgcactgcctttatgagctgtaacatcgtgaaggtctgcagcttcacgccagaggccagcgagaccacgaacccaccagaaggaagaaactcggaacacgtccgaacatcagaaggaacaaactccggacatgccgcctttaagaactgaaacactcaccgtgagggtccgcagcttcattcttgaagtcagtgagaccaagaacccgccaattctggacacaaggagatcgagaccatcctggctaacacggtgaaaccccatctctactaaaaatacaaaaaatttattaggcgtgttggcggatgcctgtagtcccagctagtcccagctactcccagctacttgggaggctgaggcgggagaatggcatgaacctgggaggcggagcttgcagtgagccgagattgcgccactgccctcaagcctgggcgacagagcaagactccatctcaaaaaaacaaaacaaaaacaaacaaaaaaaccctctgtttcccgaatgctcagggagactgatttgagtaataataaaactcctggctggacacagtggctcacgcctgtaatttcagcaatttgggaggccaaggccggtggatcaccttaggttgggagtttgagaccagcgtgaccaacatggagaaaacactgtctctactaaaaatacaaaattagccaggtgtggtggcaagtgcctgtaatcccagctactcaggaggctgaggcaggagaatcacttaaaccctggaggcggaggttgcagtgagccgaggtggcaccattgtactccagcctgggcaaaaagagcaaaaccgtcaaaaaaaaaaaaaaaaaaaaaaaaaaaactccggtctcctgcacagctggctctgtgtgaattactctttattgcaattttgctgtcttgatgaatcggctatgtgtaggcagcgggcaaggtgaacccctttggcagttacagggggaagctaaggctcaggacactcgcagaaacctgaggaggctagaattttaccagattacaagccttaaaatcaaacctgaagttagtgccagcgaacaacacgcttaaaaataactaagatgttctttctggctgttctagaggtcaatatagaaaaatgatagtaactttgatgttattttatgttatgtatttctttttttcttttgagacggagtctgtctctgttgcccaggctggagtgcggtgacgcaatcttggctcactgcaacctccgcctcccgggttcaagatattcttctgcttcagccatccaagtagctgggattacaggtgtgtaccaccgtgcctggcagttatgtgtgtttccctacaatcaaacaatgatttattgtaaaaaaaaaaaaaatcaaaataaacaaaacctgaaaacttgtatgtgctcttttaatcaatctttttaaacaaacttttagaagagttaacattattaaaaactggaaagatcagacatggttttttcttactaagatatcactggctgttttgattctttcatcacgtacaagtttaggccctacacaatggttcatgcctgtaatcccagcactttgggaggccaagacaggtggatcacctaaggtcgggagtttgaggccagcctgaccaacatggcgaaaccccgtctctactaaacataccaaaaaaggccgggtgaggtgactcacacctgtaattccagcactttgggaggccaaagcaggcggatcatgaggtcaggagttcgacaccaacttggccaacatggtgaaaccctgtctctactagaaatacaaaaattagccgggtttggtggcaggtgcctgtagtcccagctacttgagaggctgaggcaggagaatcgcttgaacccaggaggtggaggttgtagtgggccgggatcatgccactgcactccagcctgggtgacagggcaagactctgtctggggaaaaaaaaaaaaattagctgggcgtggtgacacatgcctgtaatcccagctactcaggaggctgaggcaggagaattgcttgaacccaggaggaagaggttgcagtaagctgtgatcatgccactgcactccaccctggacaacagagcgagactctgtctcaaaaaaaaaaaaaaaaagtttaaggccaggcaaggtggctcatgtttgtaatcccacaattttgggagactgaagcaggaggattgcttgagggcaagagtttgagaccagcctgggtaacatagcaagactcccatttctacaaaaaatcaaaaaattagccaggcatgatggcatgtgcttgtagtcttagttacttgggaggctgagaggggaggatcacttgagctcaggagttcaaggctgcagtgagctatgggtgtaccactacactccagcctgggaaacaaagcaagacactgtctcaacaacaaaaaaagaccaagtatatttagtcattctataaaatttaagaagccagccaaaaacatttatgttcagcaatttgtttcagttatttcttcttacttggaaataatacacacatctaatgaataatagttaatttaatagaacataatagaagatttaaaattacatgaaaaatttatttataataaattatccattacatactttatttttaacagtttccctagattatttatgaaaactgagatattaggcaaggatagtcattatttcaagttacttccctgttaatcatttttatagcctgtgacaatcaggtattcacctaagtaagaagcttaaacatatgagtaatttcttgataactcaggagatacagttttttttttttttttttttgaggtggaatctcgctctgtctcctaggctggagtgcagtagtgtagtctcggctcactgcaacctctgcctccaggttcaagcgattctcctgcctcagccccccgagtagctgggactacaggctcctgccaccacacctggctaatttttgtatttttagtagagacggggtttcactatgttgtccaggctagtcttgaactcctgacctcaggtgatccacccacgtcggcctcccaaagtgctgcgattactaaaccaccatgcccggccgatatagatgtttttactaaatgaaaaatattaaattagtattacttatcaaaaattacacaggctgggcgtggtggctcagatctgtaatcgcaataatcacactttttctttttcttttttcttttttttttgagacggagtcttgccctgttgcccaggctggagggcaatggcacaatctcggctcactgcaacctccgcctcccaggttcaagtaattctcctgcatcagcctcccgagtggctgggattacaggcatgcaccaccacgcccggctattttttttttttttttttttatctttagacagagtttcaccatgttggctgggctggtctcaaactcctgacctcatgatccatccgcctcagcctctcaaagtgctgatattacaggcgtgagctactgtgcctagcaacactttttctttttctttttttttttttttttttttttttgagacggagtctcactctgtcacccaggctggagtgcagtggcatgatctcagctcactgcaacctccgcctcccaggttcaagcaattctcctgcctcagcctcccgagtagctaggattacaggtgtgtgccaccatgcctggctaatttttgtatttttagtagagatggggtttcactatgttggtctcaaactcctgacctggtgatccacccccttcagcctcccaaagtgctgggattacaggcatgagccaccatgccctgcgtcactttttcttttaattaatttaaaaaaatttgtttttagacagagtctcactctgttgcccaggctggagggcagtggcttgatctcagctcactgcaacctccacctcctgggttcaaatgattctcctgcctcagcctcctgagtagctgggattacaggtgcgcaccaccatgcctggctatttttttttttttttgagacggagtcttgctctgttgcccaggctggagtgcaatggcatgatctcggttcactacaacctctgccttccaggttcaggcgattctcctgcttcagcctcccaagtagctgggattacaggtgcccgtcaccatgcccagctaatttttgtatttttggtagagatggggttttgccatgttggtcaggctgctctccaactcctgacctcaggtgatctgcccgcctcggcctcccaaagtgctgggattacaggtgtgagccactgcgcccggccattttaatttaaatagagatggggtcttgctgtgttccccaggctggtctcaaactcctggcctggagcagacctcccacctcggtgtcctgaagttctgggattataggcataagccaccatacctagcctaatctaaacactttgggaggcaggaggattgcttgaagatagtagttcaagaccagcctgggcaacacagtgagactccatctctaccaaaaaaaaaaaaaaattagctgggcatggttccatgtgcctgtagtcctagctactcaagaggctgaggcagaggatcacttgagcccaggagttcgaggttacagtgagttatatcatgctacctggacagcagagcaagaccctgtctctaacaacaacaaaaaattatacaaacacagatcattttgtttaaaactggatttgtagtcttataacccttgtgtcagaccctgacaccttaaaacatctagtagagataaatataaaactgtctggccagtaaacccaagcaaaaatgtatgctgataattctgaagacatttctatttttattttaccaatactttttttctttgtcttttttttttttttttttttttttttaaagagagttttccttggtcacgccagctggagtgcagtggcatgatctcagctcactgcaacctctgcgtcctgggttcaaacaattctcctgcctcagcctcccaagtagctgggattacaggcacttgcctccacacccagctaccttttttgtatttttagtagagacaaggtttcctcatgttggccaggctgatctcaaactcctgacctcaggtgatccacccacctcacccttccaaagtgctgggattacaggtgtgagccaccaagcctagcctattttaccaatagttttaaaaccagcttatttattaaagattaaagatttacggcagggcacggtggctcatgcctgtaatcccagcactttgggaggccaaggtgggcggatcacgaggtcaggagatcgagatcatcctggctcatagtgaaactccatctctactaaaaaaaatacaaaaaagtagccaagtgtggtggcccacgtgtgcctgtaatcccagctactcgggaggctgaggcagaattgcttgagcctgggagacggaggttgctgtgagctgagatcatgccactgcacttcagcctggccgacagagcgagactctacctcaaaaaaaaaaaaaagaaagaaaaaaaatttttttttcagtttcggctgattgaggtggctggtgcctgtaaccccagcactttgggaggccggtgtgggaggattgcttaaacccatgagctcaagaccagactgggcaacaaagtgagacctcatctgtacaaaaaatgagaaaattacctgggcatagtggtgcatgcctgtagtcccagctcaggattcaactggggaggtcgaggcaggaaaactgcttgagctcaggaggttgagctgtgtttgtgccagtgcactccagcctgggcatgagagtgagactgtctcaaaaaactgttttttatcagtttcaaatgagtttagggttaaattttcaattgtttacattttagccaggattggctaaattgtataagaaatacaaaatatctaagtgccctggaactagtaacacgtctatgttttgtttgctgatctggtttgatttgcaaatgtgggcaggaaagaactttagcaggtgttttttttattttgtttttgtttttgccttttggcctctgtgtgacagaaaaagcaacatttttatgctggacagagataccttacattattgctctgagctcaaggtttcaacttctttgatctaagagagtctaacttttatagaccttttttttggtgttttattttattttattttatttgagacggagtcttgctctgttgcacagggtggagtgcagtggcgtgatcttggctcgctgcaagctccacttcccaggttcaagagattctcctgcttcagcctcctgagtaattgggacaacaggcacgtgccactgcgcctggctaattttttatatttttagtagagacggggtttcaccatattggccaggctggtctcgaactgtttttttttttttttttttttttttttttttttttttgagacggagtttcgctctgtcgcccaggctggagtgcagtggtgcgatctcgactcactgcaagctccgcctcccgggttcacgccattctcctgcctcagcctcccgcgtagctgggactacaggcgcgcaccaccatgcccggctaatttttgtatttttagtagagacggggtttcaccgtgttagccaggatggtctcgatctcctgacctcgtgatccacccatctcggcctcccaaagtgctgggattacaggtgtgagccaccgtgcccggccccggtctcgaactcttgacctcgtgatccgcccgcctcagcctcccaaagtgctgggattacaggcgtgaggcaccgcgcctggccttataaacatttgtctagttatttttctttcttcctttctcgctttctttcttcttttttttttttttttttttttttttttttttgagatggagtcttgctctgtcacccaggccagggtgcgttggcgtgatcttggctcactgcaacctccacctcctgggttcaagcaattctctcatctctgcctcctgagtagctgggactatagacatgcaccaccacacctggctaatttttgtatttttagtagtgacggggtttcgccatgttgggcaggctggtctccaactcctgacctcaagtgatccgcctgccttggcctcacaaagtgctggcattacaggcgtgagccaccacacctagcctttttctttagattattactttttcaattaagtgtttcatcactctaagcaattgttaggcaaacctaattttatgtttttaaaacatggctagctgtcacgcccgtaatcccagcactttgggaggtcaaggtgggcagatcatgaggtcaggagatcgagaccatcctggccaacatggtgaaaccccatctctactaaaactacaaaaattatctgggtgtggtggcaggtgcctgtaatcccagctactcgagaagctgagatatgagaatcgcttgaaccagggaggcggaggttgcagtgagccgagatcacaccactgcactacagcctggtggcagagcgagactctctttcaaaaaaaaaaaaaaaaagaaaaaaaaaagaaaaggactaactggtctgaatattgtgcacctgttagtactagctactccagagtctgaggcagcaggattgctgtagcccaggagtttgaggtcacagtgagctacaatcatgccactgtactccagcctgtgcaacatagcaagatactgtctttaaaaaaaaagttgtctaggttgttggttaccatggagttgtaatttgaaagccctttaagacttttgtttaatcttgacttgaatgccataagcagtaagtgttatctcaacaccaggggaaaagttagcagattcaaagcaggcagaaaaaaaaaaaggagagaaagagaacttagaagtctctccatgctaactctatagttgtaggttttatgaataatgaccatttgagctctgaattttccttgatgtaattttgctcatcagttttaaaatgtgcacaagaatgagccataatatgtagctggtggagtcctagaaatccttgcattggccaggtgtggtggcttaagcctgtaatcccagcactttgggaatccgaggcgggtggatcacctgaggtcaggagttcgagagtagcctggacaacgtggcgaagccctgtctttactaaaaatacaaaattagccgggtgtggtggtgcatgcctgttatcccagctactctgaaggctgaggcaggagaatcacttgaacctgggaggcggaggttgcggtgagccaaggtggcactattacactccagcctgggcaacaagagtgaaactctgtctcaaaaaaaaaaccaaaacaacaacaacaacaacaaaaaccagaaatcctggtacgccttcatgtttgagaatcccattccatttctttatcttgttttttttttttgagacagtgtcttgctctgtcgcccaggctggagtgcagtggtgcgatctcggcccactgcaacctctgcctccaggattcaagtgattcttctacctcagcatcacgagtagttgggattacaggtgcctgccaccatgcccagctaaattattttttttgttttggtattttttagtagagatggggtttcaccatgttggccaggctggtctcgagctcctggcctcatatgatccacctgcctcggcctcccaaagggctgggatcacaagtgtgagccaccacaccatccccattccatttcttattcatcacttgagagcaaagaccaccctatacatgctgtaatttatgggatattaggagtttagtctggtgttttagacagcaggaaccaccctagtggcttatgttagccatcctccacccactggttggaatgtttatttttgctcttgggagatttttagaaataagcaagagaaaagagtcaaaccaaatccaaagaaaccaagataagagtgttcacaaaaattttaatccaaactggccatgcagaccaaaggttgcagtgagccgagattgcatcattgcactccagcctgggcaaaaacagtaaaactccgttaaaaaaaaaaaaaaagagggaggctcagcctgagagaagactcagcagggcagaacaggcctgttgtggaagcagagagctcacagccttcagtgagtgctgcatgccagttctaagaatcatcgattcttgggaggctgaggcaggcagatcacctgaggttaggagtttgagaccagcctggccaatgtggtgaaaccctgtctctactaaaaacgcaaaaattagctggacatggtggcgggcgcctgtaatgccagctactcaggaggctgaggtaggagaattgcttgatcctgggagacggaggtggcagagagctgagatcgtaccactgcactccagcctgggtgacagagcgagactccatctcaaaaaaaaaaaaaaaaatcatcaattccttctaatagtgattttttcaggtaccatttctatatatagatataccatgtatatctacctaataacagagggtctttaaaagaaaatgatgtttatttgggaatagtgcaatgggaatacatatgctatagcaaacaatgtgtgtattcagggaggtaaaggaacaaagatcaacaacaatgccaggcacagtggctcacgcctgtaatcccagcactttgggcggctgtggtgggaggatcacttgaggccaggagtttgagaccagcctgggcaacatagtgagaccccatctttaaaaaaaaaaattttttttttaaattacctgagtgtggtggtgtgcacctatggtcccagctactcaggaggctgaactaggaggatcccttcagcccaggagtttgaggctacagtgagctataatcatgccattgtactccagcctgggtgacaacatgagaccccaaaaggagaaagagagtgagagaggaaggaaggaaggaaggaaggaaggaaggaaggaaggaaggaaggaaggaaggaagaaaagaaagaaagaaagaaagaaagaaagaaagaaaggcagagaaagaatattagctgggcatggtggcatgtacctgtagtcccacctactcaggaggctgaaatgggaggattgcttgagcccaggagttgaagaccagcctggacaacatagcaagaccctatctctacaatatatacatatttttttttttcctgagatggagtcttgcttgcccaggctggagtgcagtggcatgatctcggctcactgcaacctctgcctcccgggtttaagcaattctcctgcctcagtctcctgagtagctgggattacaggtgtgagccaccacgcccagctaatttttgtatttttagtagagaccgggtttcaccatgttggccaggctggtctcgaactcctgacctcatgatccccctgccttggcctcccaaaatgctgggattacaggcgtgagccacctcacctggcctttttttttgagatggagtctccctctgtccccaggctggagtacagtggtgcgatctcagctcactgcaacctctgcctcctgggttcaagtgattctcctgcctcagcctcccaaatagctgggattataggcccccccacgacgcccagctaatttttgtatttttagtagagacggggtttcaccatgttgtccaggatggtcctgatgtcttgacctcatgatccacctgccttggcctcccaaagtgtgagattacaagagtgagccactgcgcccagccaaaatattgttttaaattagccagatgtggtggcacacacctatattcccagctactttggaggctgaggtgggaggatcacttgagcctaggagtttgaggctgcagggagctatgatcgcaccagcgtactccagcctgggcaacagagaaagaccctgtctcaaaaaaaaaaccaaaatagttatgctccttggagttgtgtccttggcactcttggttcctgagtctatatggcgggtttttgtttgtttgtttgtttttgagatggagtctcactctgttgctgaggctggagtgcagtggctccgtgtcggctcactgaaacctccgtctcccgggttcaagcaattctcctgcctcagcctcccgagtagctgggattacaggcgcctaccaccacacccgattagtttttatatttttagtagagatggggtttcaccatgttagccaggctggtcttgaactcctgacctcaggtgatccacccaactcagccccccaaagtgctgggattacaggcgtgagccaccgcgcctggcctacgtggtggttttaaaacatgtttgcaaaatttttaacattcctcctattgaaaatagtaagtctaattcccctcctcttgaatattggctggccttagtgactgaatcctcacaagtagaatgcatcaggagtgtcacactatgacttccaaggctaggttgaaaatataaaaggggtaaagctctctttcctctgtcgctctatttctttctctttctctctatccccacccttttccctctcctccctctactcacctttggaacccagccgctatcgagcccaacacacacgcaggtgccctggttaaagtcctagctagggtcccaagtgacagccagcatcaactataacatgtaaaggagccagtcttcagatgattccagcctcagccttcaggccactcagctggtgccaaatagagtagggatgagctgtccccacagagacctgcccagtgcacattgtgagaaaggtaagtattgctctctgaggccattaagtttgggggtggtttatggcataaaaattggtaattggagcactcgacttcaagggttctcaccaggtgtgtgagggtgagggtggccctgcggagtgagtggcctgtgggggctggtcatatttcatccctaggctctcccgacctggctctgccagattcttacacggatgagggcctggactggggaggaggagggggagtgcagcagcagcaagggcatggaattggctgagaaattccacaggaggccaggtgcagtggcttacacctgtaattctagcactttgggaggccgaggcaggtggatctgaggtcaggagtttgagaccagcctggccaacatggccaaaccccgtttctactaaaaatacaaaaataattaggcatggtggtgggtgcctataatcccagctactcgggaggctgaggcaggagaactgcttgaacccggggggcggagattgcagtaaaccaagattgcaccactgaactccagcctgggtgaaagagaaactctgtctcataaaaaaaaaaaaaaaaaaagaggccgggcgtggtggctcatgtctgtaatcccagcactttgggaggccaagtcgggtagatcacttgaggtcaggagttcaagaccaggctggccaacatggtgaaacccccgtctctaataaaaatacaaaaattacccggatgtggtggtgctggcctgtaatcccagctgctctgtagactgaggcaggagaagcgcttgaacccgggaggcggaggttgcagtgagccgagatagcgccaccgcactccaggccagcggacagagccagactctgtctcaaaaattaaaaaaaaaaaaacaaaaagaaactaggaaactggcaggagctgtctccaggtcccaaaaggataaagtgaaaaacccggcaggccagcagatggccaaaaaagccatccctagctgccctcattgctcattagggtaagacactctcatcagcgccatgacagtttacaaatgccatggcaatgacccagagactattgccgtttccatacaatgacccagaaattaccacccctttcctagaaagttctgaataacttgcctcttgatttgcattaacccaccccttaatttgcatgtgattgagagtggatataaatacagttgccaccaacccacaagcctggttctggcaccctgcctatgagttagccttgctcagcaaggagcagctccagttcgataaaagattgctgaagattggccaggcgcagtgtctcacgcctgtaatcccagcactttgggaggccgaggcgggcgaatcacaaggtcaggggatcaagaccatcctggctaacatggtgaaactccatctctactaaaaatacaaaaaaaattagccaggcagggtggccggcgcctgtagtcccagctactcgggaggctgaggcaggagaatggcgtgaacccgggaggcagagcttgcagtgagccgagattgcaccactgcactccagcctgggtgacagagcgagactccatctcaaaaaaaaaaaaaaaaaaaacagattgctgaagatttcacccctgaattcttttctgggcaaagccaaggaccctcttgggctaagccccggttttagggcttgcttgcctgcccctgtatttattccagaaagttctgttggacattgttgatgggtaggaccttgggcactatccagagtgtggtcttagaatcagcatcatcaaggccaggcgcactggctcgcctgtaatcacaacactttgggaggccgggtggattacctgaggtcagaagttcgagaccagcctggccaatatgataaaaccccgtctttattaaaaatacaaaaaaattagccggacgtggtagcgggcacctgtaatcccagccatttgggaggctaaggcaggagaatcgcttgaacgtgggaaacagaggttgcagtgagctgagatggcaccattgcattctggcctgggcggcaagagcgaaactctgtgtcacacacacgtacacgaaaaaaggaatcagcagcatcaggatctcctaccccctgcccctggcaattacccatctgctttctgtccctgtggctgtatctattctagacgtttcacatgagtggaatcctgccctgtcatcctttgtgcctggctgggttccggtggcctgatgcttcatggttcacccatgcgactgcacggctccttgtccatggcatggatagactgcattttgtttattcattagttgatggatatgtgggttgtttccactttttcgctgttacaagtaatcctgctatgaaaattgatgtcccagtttttgtgtggacatatattttcagtttatcttgggtatatacccaggagtagaatgctgggtcatatggtaaatctatgtttaactttttgaggaactgtgggtggcccaatttacaactgctaagttcatccacttcttactttctccacggaactcacacttacagcagtgatagctttcacacctccctcgtccgcactgttaaacactaccacaaatcaggctactgggaaaagcctggaggccaccagcctcctgcaagaaaagcaccagcaggctgggcacagtggctcactcagtggctcatcccagcactttgggaggcggaggcacgcggatcacctgaggtcaggggtttgacatcagcctggccaacatggcaaaaccctgtctctactaaaaatacaaaaattagccgggcgggtggtgggcacctgtaatcccagctactcaggaggctgaggcaggagaatcgcttgaacctgggagatggaggttgcagtgagccaagatcacgtcactgcactccagcctgggtgacagagcaagactccctctctctaaaaaaaaaaggaaaaaggaaaagcaccaacacaggtgacgcaggtcctctaggagaccgtgtctggttctcttcctgccacacgcatgccactcatgccgctgaagccaaaacacctcctcctatgtgaccagaattctgggtcattttatgatttctttctttttttaaattaaaataaaaaaatttttttagacacacgatctccctatgttgcccaggctggtctcaaactcctgggctcaagcaatcatcctgcctcagcctcccaaagtgctgggattacaggcttaagccaccaaactagacctttttttgtttttattttttagggacaaggtcttgccctgctacccaaaccagagtgcagtggtacgatctcggctcactgcagccaaaacctcctaggcttaagtgatccttccacctcagcctcccaaagtgctgggattacaggcgtgagccaccacagtagacctcctttttgttttattttttagggacaaggtcttgctctgtcacccaggccagagtgcagtggcatgatctcaactcactgcagcctcaacctcctaggctcaagtgatcctcccacctcagcctcccaaagtgctgggattacagatgtgagccaccatgcttggccccatgagacatttaaatcttcaagaagagggtccagggcttcctgttgttcttcccatcaccctcgcccctctgcagggggtcctaacgcagctaacagttccagccttcttcaggggcttcttgctgtcagcacggaataaagtcagagctgagctcaggagagttccgtcactcgccaagactggccaggtctcttctgtccttggctgtcaagattccaaacttgagaagtgagaaaaacaatgggaatgagttagaaagttcccaagtgccacctttctgaaggaattccagggtggaacaagctgggttttgcagccagttagccctaagattaaatctgagcttctctgtttaatagctgtgagagtcttagcaactacttaatttgggtgggtctgaatttctatttttcactaattcccagcgtgaatggctgtcaggggggtaatagtttatttatttatttttatttaatttaattaattaatttatttttgagacagtctccctttgttgcccaggctggagtgcagtagtgcaatctcagctcactacaacctccgcctccttggttcaagcgattctcctacctcagcctcccaagtagctggaataacaggtgtgtgctaccacgcccggctaacttttgtatttttagtagagatggggtttcaccatgttggccaggctggtctcaaactcctgacctcaagtgatccgcctgccttggcctcctaaagtgctgggattacaggcgtgagtcattgcacccggcctggataatactagtttagataaaccacttcataaagtgggtatgcaatgctttgtttcctctcaccttgacccagcattgcttgtcatctctgaaagaccacaaagagacctgcccctccacttcagggacccacttgaaacctggtcaccatccaggcttgctctgccttggccatcaggttccctgggcaccaagcctctcttttctcccgctgcacctgccagcccgtctgacagcactggatcctgcaccctggagtccgtttggactcacctgccctgaccttacttggcttcctctgtgatgttgactttatcgaccgcttttgccagcctggtctgtcggccacaccctacccataaatcttctaccttggatctatacaactgcctcccttttgtcctgtccccagggtagtgagccctccagggcctgcagccccagctgtcctgatccttttctcctgaagcaaaggaagatgtgttcatagtgtacccactgctgatctttctcctctgtccaaacatctccagtcctgtgctactgccctggacataatcgtttattttgtttttttgttcttttttttttttttgacacagagtctcactcggtagctcaggctagagtgcagtggcatgatcttggctcactgcaacctccacttcccggattcatgtgattctcttgcctcagcctcccgagtagctggaattacaggcacgcaccacctcacctggctaatttttgtatttttagtacagacggagtttcaccatgttggccaggctggtctcaaactcctgacctttggtgatccacccaccttggcctcccaaagtgctgggattacaggcatgagccaccgtgcccggcctgccccggccatattagattctgagtcttctatgtccctgacaattggctaagcacattttaatatgtcttgtatttttttttttttttgagcagagtcttgctctattgtccaggctggagtgagtggtacagtagcggctcatagcaacctctgcctcccgggttcaagcgattctccctgcctcagcctcccgagtagctgggattacaggctcccgccaccatgcccgactaatttttgtatttttagtagatgcagggtttcactatgttggtcaggctagtcttgaactcctgacctcaggtgattcgcccgcctcggcctcccaaagtgctgggattacaagtgtgagccaccacgcctggccctaacctgatgtttttatcagcatctgtaagataagacttcaggaactggtagattctgcaggagtaacatggggtgcccatagagaaggggccctcttatgaccacagcatttaccataacctgtgtaatgggcatattcagtgggtgaatattcctgtcaccacaaacccagttgcacatgacttgtatacaaagcatatcagctgcttcaccaggggtgctccaattggcgtttataggggaagttgggcagttcccttctgagggtaaacatatgtttgttttttttgtttgtttttttttttttggagacagggtctcacattgtcacccaagctggagtacagtggtgcgatcacagctcactgcagcctcaacttcccaggctcaagcgatcttcccacctcagcctcctaagtagctgggactacaggggctcaccaccatgctcagctaatttttttatttcttgttgagatgggatttcatcatgttgcccaggctggtcttgaactcctaagctcaagtgatccacccacctcagcctcctaaaatgctaggattacaagcgtgagccactgtacctggccaacacacttagcagtggcttttatccactccaccaggctatgagcatgctggcccttcatgaatattcataggtcctcttataacctgttgaatacgtacaccttgtcaacccattcagcataaattcctgtctcatctttctctccctcaaaatgatctatgccagaggctacacttcccagcttgtcaagatggccaccctaccaccgcaacccctgataggaaataatgtctcctctccaaatttgtagatatctgtgtttgtttgtttgtttgtttttcctgagatggagtctcaactctgtcccccagactagagtgcagtggcaaaatcttggctcactgcaacctccgcctcccaggtgcaagccattctcctgcctcagcctcccgagtagctgggactacaggcatgcgccaccatgcgcagctaatttttgtatttttggtagagacagggtttcaccatgttggcaggctggtctcaaattcctgacctcaagtgatctgcctgccttggcctcctgaagtgctgggattacaggcatgagccaccatgcctggccagatctccagattttaagttgatgccttagaatatcacattgtcgtatgttctagacagtgatcactcttctgaggaggaaaactaataaagggaacaaagggcaaataaattaaacaaaggtcaaaaccaaagcattgcagttgcaaagcaattcagtaggagatgtggaaattgtgaagcagaaactccaaagttaaacaaagttaccatgtaaattacaccacaataaaaacaaacgaacaaacaaaaaacagaaagttaaaaccaggagcttcagttgtccaaatcaatggacataaaattcttcttccagtcttatgatgcatttgacaagatctccagtatctactcaagttaacccatgaaatatagctaatggtagatgagtaagataaaggctgtccagatctttatctgaaagaggccgaaaagaaagaccagagtatttcgtgaaaatctgaagggagaataaaaatttcacttactacctaccacgtgccaggcctgtaccagggggttgaaaaaaattggtgggtcttattatctccaatttacagatgaaaaaactgaagctccaggccgggcacagtggctcatgcccttaatcccagcactttgggaggccgaggcaggtggttcaccagattaggagttggagaccagcctggccaatatggtgaaacctcgtctctactaaaaatacaaaaattagccagatgtggtggcacttgcctgtagtcccagctactcgggaggctgaggcagaagaatagcttgaaccagggaggcgggggttgcagtaagccgagatcacgccactgccctccagcctgggcaacagagtgagactccatctcaaaaaaaaaacaaaaaacaaaaaaaaaactgaagctcagtgggttacatggtaggtaagggctggagccaggtgttaaacccatgtatctgttaaaattaaaacttaagacaaattaaatttaagagagtttaattgagcaaagaacaattcacaaatcaggcagctccctgaaccagcataggttcagagaaactctggggctgccatatggttggataataattatagacggaaaaaggaaagtgacatacagaaaatggagatgaggtacagaaatagccagattggttaaggtgtggcacttgccttatttgaacatggtttgaacagttggccacttgtgatgggccaaaactctgtggttggtataagagaaggttatagtctatttacatgtccagttaggccactaggtgaggagaaacctttaggcctaaattaaaatatgtaaggaggcagctttaggctaaacttaatttaacaattctcttggccatgcgcggtggctcatgcctgtaatctcagcactttggagggccaaggcaggcggatcacctgaggttaggagttcgagaccagcctggccaacatagtgaaaccccatctgtactaaaaatacaaaatttagctgggtattgtggcaggcgcctataatcccagctacttgggaggctgaggcacgagaatggattgaacccaggaggtggaggttgcagtgagccaagattgtgccgctgcactccatcctgggcgatagagctaagctcagtctcaaaaacacaaacgaaaacaaagaaaaccaattatctctttttggccaactttcaattttgagagattgataaaaagctttaggcattgatgtcactctgtcaccaccgtgaatggacttttttggtctaaaatcccactaggaaacatagcagtgggttttgtaaggtgggaataaggaaatagagcaataaggaaaaacctcgttattccaggttacttttttgggatgggttggagcagaggggagcttcttattatgctggaatttgttttcaggaggaaaaacctggtctgttttgggatctctctgctttctttgaagtttgagtttgattatgtagcatttagcatgggtgactccattttggtttggtcttttggggtctagttcaggagctcaggccagaaaaacagcctcccataactttacttaacatctctttataacattctgtccacaaatgcttggtacgtggctataggtttctggcttaaaaaatgattaacaatgtacccttacctaccctgaatctgagcccctgcagcctctctcatactactgtggccacccaagctgccctgaggtttcccaaccaaggtggctcacatccgtattcccagcacttgggaggctgacgtgggaggatcacttgagcccaggagttcaagaccagcctgagcaacacagtgagacttcatctctacaaaaagtaaaaatgcaaaaatttgctggggggtggtcccagattcttgggaggctgaggtggaaggatcaatagagcccaggaggttgaggctacagtgagctgtaatagtggcactgcactccagcctgaggtacagagtgagaccctgtctcaaaaaagaaaaaaataaataaaagtgaataagaaagcaaagaaaacccaatacaaaccctgcaagaagagagacagagaggtgaggaaagacaaaggaggaacggttcatagaagtctcgttgtagcctgggcccaaggtgctgtattcattggataaccatccacggatgcttactctgtaccaggtgtgatgccagatgctgggaatttggagatgactgagtcatggcccctgcctgagaatgagctctcagtttagtggagaaggcttacatgtaaacatataaattatagtgcagggtaattagaaccataatagagtaatgtaggaaacacacagaagccaaagaaaggaatgatgaattctatttgaagaggaggagctgggaggagaagagagctgaggccttcctgtgagaagggtgggtggtggtgcaggctggtggtggtcccctctgaataacctggaggttgccaggtgggcagaaggaggagagcattttaggcagctggagtgtgcatgggcagagttgaagattagcaattgcaggtcactgtgggcggagagcaggactccccttggcaacctggtgaagtcacttctgcccattactttattcattggaacaactaagagtgaacagaaaagcagcgctcatgccgtcagacccttcttccaaatgaaaacgtgcaccaaggcccagtgtataaataggaagcagataatgtttttttcttaacaggaaacagatctcccactgtttggaaatatattttgaaactttttttttttttttttgagacggagtttcactcttgtcacccaggctggagtacgatggcgcgatcttagctcactgcaaactccacctcctgggttcaagcgattctcctgcctcagcctcccaagtagctgggattataggtgcctgccaccatgtctggctaatttttgtatttttagtagagacagggtttcaccatgtttgccaggctggtctcaaactcttgacctcaggtgatctgccagcctcagcttcccaaagtgctgggattacaagcgtgagccaccgcaactggccaaaacatttttattattttattttatttatttatttatttgagacacggtcttactctgttgcccaggctggagtgcaatggcatgatcataactctctacagcctcaaactcctgggctcaagcaatcctccgacctcagtcctccaagtactgagactgcaggtgtgtaccactatgcccagctaatttttttttttttttgagatggagtctcgctctgtggcccaggctggagtgcaatggtgcgatctctgctcactgcagcctctgcctcccgggttcaagccattcttctgcctcatcctcccaagcagctgcagcagattacaggcatccaccaccatgcccggataatttttgtatttttagtagagacaaggtttcaccatgttggtcacgctggtctcgaacttctgacctcaaagatctgcctgccttgccctcccaaagtgctgggattataggtatgagccacagtgctcagccctcaaataatttttttaaattagttttttagtttttgtggggatgggtggggggggtcttgctatgatgaccaggctggtctcaaactcctggcctcaagctatcgtcctgccttggcctcccaaattgctaggattacaggcatgagccacaggtgtcggaaaccttctggatgggggtggagaggcagatccccaccacaggtctgaaattgcatcaaaactttgaaaagagggcaaagctgcttcacctgagagagggaggagctttcaggggaattctagatgggaggggagaaggtcacaccacatctgccatgcctgtctccactcttaccctgcccaagtccctcctccactttatcaaaatcaggagagagcaatccttctaaaatgcaaatatgagcatgtacccctctgttcaaaacccttccatgtctcccctcactgtgagaaaagaagccaaactcctccaggccgggcgcggtggctcacacacctgtaatcccagcactttgggaggccgaggcaggcggatcacgaggtcaggagttcgagaccatcctgccaacatggcgaaaccccgtctctactaaaaatacaaaaattagctgtgcgtggtggcgcatgcctgtaatctcacctacttgggaggctgtggcaggagaatcgcttgaaccagggagtcagaggttgcagtgagctgagattgcatcactgcactccagcctggtgacagagtgagactccatctccaaaaaaaaaaaaaagccaaactcctgaccacacctctcaggctctgcacactctgcccactggctgctgcccaggcctcacaggtcggcttccctcatttccctccagccaccctcctctcttcattatttccaaattcatcacactttcagcttgttatctatggcagataacctcattatggcagaaaataagactgaagcatgtgaccaaacatagacagactttttcacaagatagtcagtctcttgggcttattcaaattccaaagagaatcatttacaagttaattcctatctttcgggtccattcatttctccttttaaaatattttttttttgtttatttatttatttattttgagacggagtctcgctctgtcacccaggctggagtgcaatggcatgatcataactctctgcagcctcaaaatcctaggctcaagcaatcctctgacctcagtcctccaagcactgagactgcaggtgtgcaccactatgcccagctaattttttttttttttttgagacggagtctcgctctgtggcccaggctggactgcaatggtgtgatctctgctcactgcagcctctgcctcccgggttcaagcgattcttctgcctcagcctcccgagtagctgggattacaggcacccgctaccgtgcccagctaatttttttgtgtgtgtttttagtagagatggggtttcaccattagccaggatggccttgatctcctgacctcatgatccgcccgcctcggcctcccaaagtgctgggattacaggcgtgagccactgcgcccggctatttttttgaaacggagttctgcttttgttgcccaggctggagtgcaatggtgcaatctcggctcactgcaacctccacttccctggttcaagcgattctcctgcctcagcctcccaagtagctgggattacatgcatgtgccacaacacctggctgatttttgtattttttagtagagacggggtttcaccatgttggtcaggctgatctcaaactcctgacctcaagtgatccatccgcctcgggctcccaaagtgctgggattacaggtgtgtgagccactgcacctggccccattcatttccccacaaaatcacatactacctctcaacattgctgcacccccatttcccctcccctgtgaagaaggcagctacataagcatctggaccacgttgggttattaggtcatcgttctcctgtggtttccttatgcttgtacatgtgacataaattttgtacacatttttctcctattaatttgccaattgtcagttcctttttggggagcctttatagggctagagagcagaaaggaagctttcccttggccctacagctccttgaggtcggctgttgactcttttcttcattgctgtctcttcagcgtctagaatggtacctccaatgtagagatgcttgataaacgtgttgagccgggcacagtggctcacgcctgtaatcctagcactttgggaggctgagggtggatcaagaggtcagagttagaaacaagtctggccaacatggtgaaaccctgtctctactaaaaatacaaaaattagcaaggcgtggtggtggatgtctgtaatcccagctacttgggaggctgaggcaggagaatcgcctgaacccgggaggtggaagttgcagtgagccaagaaagggcagcagagcaagaccccatcttgaaaaaaaaaaaaaaaacaagcaaacaaaaaacaaaaacaaacaaaaaaacatgtgttgagttgctttctgtttagtagcagaaagctctggaagggctttggacattcacgcgtgcaggcccgggaacgggatgaggtttaaggcaacttcatctagagtttaaaaggggcaggtaggcccacagctggcacgtgggttaaatgtaaagtggctcaaacaggatctgataaggcagaagcagagatgggggcctggtgtctcactgccttcacgttcttccttctgcctcagtccccacatgagagtgcaccctagaggtgccagcattagcgatagggcagctttccttgtttctgggatggacagaaaatgggccttgagacccctcccatcataggaaagcatctcttgcactctggagactgaggacttgctatagtggaacaagaagcagtcttcggcaatggaggagatgctggatctccatacaggcagggtgggtgcaacggagtggagctgtggcaaatgtgggtgcctctgtcctgagggtcctggatgtgtcatgcctgggaacatgagggcgttcttccaaggtgcccatctcgacctctctgagctgccatctttgacttcctgtgtttggtcacagactaggggtggtctgtccctaaacagaagaagacaagcaaggattagagaggagaaagagctagagagagagcttgggagagatgtagggacaaggaaagaagaggcagaaggaaaaaggcatggagggaaggaatataaaaaaaaaccccttaggccaggcatggtggctcacgcctgtaattcccgcactttgggaggccaaggtgggtggatcacctgaggtcatttcaagaccagcctggccaacatggtgaaaccccatctttactaaaaatacaaaaattagccaggcatggtggtgggtgcctgtaattctagctactccggaggctgaagcaggagaatcgcttgaaccctggaggcagaggttgcagtaagctgagatcaggccactgcactccagcctgggtgacagagcgagaatctatctcaaaaaaaaaaagaaaaaagaaaaaaaggccgggtgtggtggctcacgcctataatcctagcactttggggggctgaggaaggtggatcacaaggtcaggagattgagaccatcctggccaacatggtgaaaccccatctctagtaaaatagaaaaaattatctgggtgtggtggtgcgcacctgtagtcccagctactcaggaggctgaggcaggggaattgcttgaaccctggaggcagaggttgaagtgagtcgagatcgcgccactgcactccagcctggcaacagagcaagactccatctaaaaaaaaagaaagaaagaaagaaagaaaaatcctccccagagcagggaaagatgaagacataaagggaaggagagtcaccaggaaagagagagggagagagacacaaaacaaaatggctggaatgaggtgaaagttatagtagcaggatgtgctgacactgaccttggagaaaaagagaggggaagggaggagtgaacgtggaatctttggctgctgttctgtttcactcccagaactcaccaccctggattccccccatttccagatcctcaggcgggactgcctttgctatctgggatgagtcattggccccagatggtaaacctgtgaggggtggggtgctctgaatgcctgactagtcatttataattgagagcacttattccagccccttctggtcctccatccttccctcttcttggacctcctgattcagagaggtcagagggccagtccaggaggggtcaggcactaggtccctggagtcagtcttagggattttaggcagagaggaatcagtcctgaaaatgaagggcatacagagaaaaaaaaaactatgacatcacccctgggggtgttacagacctaagaaagaagcaatggccctgggcggcctacagccccaggaagattcagccatggtacccaggagacttgagggcccaaagcccagaattacccccagaggaacacctgtagaccttcggatccttagctttgcacttcccattggactgactctgtttcctgtggggcaataggcacgtgttcactgtgcacctgcagccccagtcatccttctcagagagaaatggtttgggaagtgtttggcatattggggataaatagatgagtggatagaaaaaaaaatgcaggccaggcacagtggctcacgcctgtaatcccagcactttgggaggccgaggtgggcggatcacgaggtcaagagatcgagaccatcctggcaaacatggcgaaaccctgtctctactaaaattacaaaaattagctgggcgtggtggcgcatgcctgtaatcccagctactcgggaggctgaggcaggagaatcgcttgaacctgggaagcagagattatagtgagccgagatcgcgccactgccctccagcctgagggatagagcaagactgtgtctccaaaaagaagaaagaaaaaaaagcaattacagcaaaatattaaccatagtagaatctatacagtggttatataagtgtccactatacaattctttttttttttttcctttttttgagacttgatgtttcgatcatggctcactgcaactttgacctcctcagctcaagtgatcctcttgcctcagcctcctgactagctgggatcacaggtgtgcaccaccatgcctggctaattgttttattttttgtagagacgagatctccctatgttgcccatgttggtcctgaactcctgagcttaagcagtcctcctgctttgacctctcaaagtgccgggattacaggcatgagccactgcacccagtcttgctatacgattcttttgttttttttttttttttttttgagatggagtctcactctgtcgcccaggctagagtgcagtggagtgatctcagctcactgcaacctctgcccctcaggttcaagtgattctcctgcctcagtctcctgactagctgggatcacaggcacctgccatcacacccagctactttttgtatttttagtacagatggggtttcgccatgttggccaagctggtctcaaactcctgacctcaggtgatccagctgcctcagcttcccaaagtgttggattatgggtgtgagccactgggcccagccactgtacaattctttaaacttttatatgtgtttggatttttcataatattagaaaagggaaagaaaaaaatgtctggcaaatagtcagcactcgtaagtataagattttgggaatatattcccttctgggagaatccacatttcgaatgcctgggaagggctctgtttgtcctgacagatggcagatttcaggtgagagcacctactaagcctagaggtgataagctactttgcccacctagagctgctggtggtgaccttaagtttactatgtttctcctggtatacggcacttggcccagagtggactccagcttgccacctgtcacccaggctggagtgcagtggcgtgatcttgtctcactgcagcctcaacgtcctgggctcaggcgatcttccctacctccctcctgattagttgaggctacaggtgctcgtcaccatgcccggctaatttttgtttttgttttttgttttggtagagatggggtctcacactcttgcccaggctgagctagaactcctggcctcaagcgatctgcctctgcctcccaaagcattgtaatgacaggtgtgagtcaccatgcccagccaggaactcagagaatcttaccctatgctgtagtatctgttgactatggggtagaggcaggataaggtgttccagaccctgcctgacacctgatccgaagaggttgctcatgtttgctcaggaggtgaggttcacacaataaagggcaggaggagggcttggacctggtataaaacatctggaagtttccagggggctgctttgcatctgaaactgtcaggtgaggggtgacagagatgcctgaatctgagttgggggggaattcaaatctgagctggcgaagaggatgcctggaaggaatggcaggaaagacttgagttaattggcgcttctgggtctgcagtaatcttaggtgcaaagctgtctaggtctctgctgaaggactggggacacctgggatgttcaggagaatagaaatggccagatgtgtgttagtggagaaaagaatagtgacacatagaccaggcacctggggtctaatatcttgagctggtcccgactccttctgcaacttctctgtctgtcctagttccaccagcactgcttggatactggtgctggcacagttccttctgtcaccaactttgctccccaggtaacatagaggcaactctaaaatgcttctttccttgagaccaggtggatgccagggatttaaaccatgctccaggtgccccataatccaggccaattcaccacagatgatgaggctttctttgctcagcctctgggctcagtaaactcagccatctctttgcttgggagaggtcctctactccctccttagaaaactcgtttcctggctatggccataccaacccaaatgtacctgggcttggctgacttcagaaaacttttctgctttgtgccaggatggaataaggcttaatccagatagttagagttcatcttcaggcctgagagaaaaagaggagggcttggctacagccagaccagggagagctggaggggtcagggacattgaaggtagcatcagagaggaacaggactacaggctatggacagtcctttctaagctcaagactgggtctgctaggtctaagttgaaggacgaagaaggcttggtctgagctgcaggtcaggagtgcctgggtcaatcaagtcaacaaggaagaaggtgaatcttcatttgctcttttcttcccactccagccccagaatgttgacagtcgctctcctagcccttctctgtgcctcagcctctggcaatgccagtaagtgagataccaggagcctggtattggggacttgggaaggcagccttgggcactgctgttggccaaggcttttggaggttggcttggggtggggagctgagttgtcggaggaacaggggtgatgcagagaaactgaactcctggaagatttctccctccaactcctgcttgcccctccagttcaggccaggtcttcctcctatagtggagagtatggaggtggtggtggaaagcgattctctcattctggcaaccagttggacggccccatcaccgccctccgggtccgagtcaacacatactacatcgtagggtaagattctttgaattcctggctgggcgcggtggctcacatctgtcattacaatgctttgggaggcagaggcagatcgcttgaggccaggagttctagctcagcctgggcaagatgccagggatgccagggatttaaaccatgctccaggtaccaagaccccatctctaccgaagaaaaacaaaaaaattagccaggcatggtggtgagtacctgtagcctcaactactcaggagggagaggcgggaggattgcctgagcccaggatgttgaggctgcagtgagccaagatcatgccactgcactccagcctgggtgacagagtctctttgttggcaaaatgagttgaagttccctgtaggatcttccagggttcacccaggcttcacagtctgtaggactagccagagacctctcatccctatcatcacctttctttctccttccttcctcccctcttcctcagtcttcaggtgcgctatggcaaggtgtggagcgactatgtgggtggtcgcaacggagacctggaggagatctttctgcaccctggggaatcagtgatccaggtttctgggaagtacaagtggtacctgaagaagctgttatttgtgacagacaagggccgctatctgtcttttgggaaagacagtggcacaagtttcaatgccgtccccttgcaccccaacaccgtgctccgcttcatcagtggccggtctggttctctcatcgatgccattggcctgcactgggatgtttaccccagtagctgcagcagatgctgagcctcctctccttggcaggggcactgtgatgaggagtaagaactcccttatcactaacccccatccaaatggctcaataaaaaaaatatggttaaggctagtctgtgtgggggcatctgtggctgggatatctgcctcctgacttagccggggacgtgcaaatctcacttctggctggctttggacatctgtctggaagatgggaagatgagggagaggtatgtaagaatcctgggctttgtgctataatttatcaagaggagatgagattctggcttgcatcaacgctcttcaaggacagctccttggaacattgatccaaactggagtcatgggtctgagggcaaggcctagttgtggcttacaccaaaaccccagatgtcccactctccagctctcctcacccctggtcctccccttgagaaagtggtgaactcacttgctgtgtgtgggtggccaggaccattagcctttgttctttcccagaacccacctgactcctgaaacttagctgaagtctgtgcccgaggaccctgccctgttaccaggcccagttcctcctcacctctacccatgagccccggtgtcctgctaagccctctcagatctgggattcctccttcctcaggaagccaccaccttctcagcagtggaaaccctgcccacactatgctcttaggctttagccatcagaaggttacagtggactgcgggaggctgacactaggctgaactcattaaggaatgaatgggaggtgagaagacacaggcagcaagaatcgagtgtttcaagaagtttggctgtggtttgccagaaataggcaagtcagttttcgggggtgtaaggaaaaagggttttgtgtctttttaaaatcctagacaggagagtcacaagcatgttcacatgataaagaggaagaaagagaaagaggctggagattctgaaaagagatcactggtgaggtctcaaaagagatagaagaggatggttatgtagttggggaaagaaattttaagaagggaagaaaattaaaatgagtgaaggtatacgttagttttgtaaaagttatcaatatctggctgggcacagtgctcacacctgtaatcccagcactttgggaggccaaggcaggcagatcatttgaggtcaggagttggagacaagcctccaacatggtaaaaccctgtctctactaaaaatacaaaaattagccaggtgtggtggcagtcacctgtaatcccagctacttgggaggctgaggcatgagaatcacttgaatgctggaggcagaggttacaatgagttgagacagcacaactgcaccccagcctggatgacagagtgagactccatctaaaaaaaaaaggaatgttatcagtatcaaaatggagtaacatatgtcacatcctaacaaaatggaaccaacctgacacctaaattaagcattgcacctgataacaccatggaggactgggtggagaatcagcagacaatggcagggagaggcagtctgtggaccaagttcaggtgaaaggatcacccatcatgttgggcatcagatcaggcaggttcacacactacctgaggaagctggtctttgtgacagacaagagctgctctgcctcttgggaaacacaggcaccagttttagtgccatcttcttgcacccaaatgctgtcctttaactcatcagttacagtgctggatccctcatcactgccaatacggggctagcaatatgtctgccccagtgaatgcagccgccacggagccccagcctcctctatggcaggggccctgtggtggggaatgaggacttctctatcattaacctccatgcagttggctcaagaaaaggatatggtagttgggcaagggggctcacacctgtaatcccagcacacttgtaatcccaggagggtcgcttgagcccaggagtttaaggccagcccgggcaacatagcaacctgtttgtaggcaaaatgaggagttgaagttccccgtaggatcttctagggctcaaccagccttcatgtgcagtgggactggcaagaaatctgtcatccctgttaccactttgaaggtctcagtgtgtatgcaggtcctgaaaagttcaagtcccacctgaaacgcaacacagcatcatgctctgattcatcagtgattccctaatcaatgccattggcttgcattgggactatctatcccagcctatccagtgacttcagcagctgcagagccccagcctcttctttggcaggggcactgtggtgaggaggaaggattcccttatcacaaatctccatccaattggttctataaacagatatggtggcccaactgttgcgggaagtcagggaccccgaacggagggactggctggagccacagctgaggaacataaattgtgaagatttcatggacatttaccagttcccaaaattaatacttttatactttcttatgcctgtctttactgcaatcactaaacataaattgtgaagatttcatgaacatttatcagttcccaaataatactcttataatttcttatgcctgtctttattttaatctcaatcctgttatcttcataagctgagaatgtacgtcacctcaggaccctgtgatgattgcattaactaacaaattgattgtaaaacatgtgtgtttgaacaatatgaaatctgattgtaaatgtgcatttgaacaatatgaaatcagtgcaccttaaaaaagaacagaataacagtgattttagggaacaagtgcagaggttacaatgagttgagatagtgcgactgcactccagcctggatgacagagcgagatttcatctaaaaaaaaaaaaaaaagaatgttatcagtatcaaaatggagtcacatatgtcatatcctaacaaaatggaacaaaaagggaagataaccataaggtctgactgcctgcggggtcgggcaaaaagagccatatttttcttcttgcagagagcctataaatggacgtgcgagtaggagagatatcgctaaattcttttcctagcaaggaatattaaatattaagaccctaggaaaagaattgcattccttggaggaggtttacaaatggccactctgggagtgtctgtcttatgctgttgagataaggactgaaatatgacccggtctcctgcagtaccctcaggcttactaggattgggaaattccaacctggtaaattttggtcagaccggttctctgctctcgaaccctgtcttctgttaagatgtttatcaagacaatacatgcacagctgaacataggccctcatcagtaattctaattttgccctttgtcttgtgatctttgctttgccctttgccttgtgatctttactggcctcagaagcatgtgatctctgtgacctactccctgttcgtacaccccctccccttttgaaatccttaataaaaacttgctggttttgcggctcaggtggggcattatggacctaccgatatgtgatgtcaccccccaccagcccagctgtaaaattcctatctttgtactctttctttttatttctcagaccggccaacacttagggaaaatagaaagaacctacgctgaaatattgggggctggttcttctgatacccaacaccatggctcacagctgtaattccaacacttccagaggccaaggcaggaggatcacttgaaccttggagtttgaggttgccatgagctatgattgtaccagtgcactccgacctgggtgacacagtgagaccttgtctctaataagaagaaaaaaatgccattttaaaagtgtacactttcatggtttttagtatattcactgtattgtacaaccattaccactacctcattccagaacacttccaccacccccaaaagaaagcagttacatctgttcactgtagtgccaattactcaaccccttgtcatcccctggcaaccaccactcaggtgtactttctatgtctgtgggtttgctattgtaatttgaaagttcactgatgttactttaatttggtttcattttgaatacagtaaatatggatcaaaacccatatatacggagcatctttagaggcctcatttttgtttttttttttttttttgagatggagtcttgcactgttgcccaggctggagtgcagtggcgtgatctcggctcactgcaacatccacctcccagattcaagcgattctcctgccccagcctccccagtagctgggaatacaggcgcctgccaccacaccctgctaatttttttatttttagtagagaggggttttcactatgttggccaggctggtcttgaacgcctgacctcgtgatgcacctgcctcggcctcccaaagtgctgggattacaggcgtgagccaccacgcccaggctagaggcctcattttttaagactaatgggatcccaaggctaaacgtttgagaaacactgatctaagatttgtgttttgttttgttttgttgttcaatcaagtggaacataatgtctaaaccagggccttacctacctggaactcaaaggtggaatgaccttccctggccaagcttccagaagggacagggagctacttaacagactgctggacccttaacgactggaaaccggaaccgtgggtgacggaaccgaccagacgtgacagccctttggctggggctgcagtcccacgatccacacaacgactctggctccgcagacgcgccaaccacccacggaggcaagaaactgccgagagtgaagggaaagggagcccagtgctgggcggcactcagcagctcccccagcggccactgtcgccaacgtctccgcgtcggggtttgtaccgcagctcgcgtccagtcgtcaatggctgcgaggcccatgcgcgctccagcgtcctgaccaggggaacgttttccttagggacccggaggcgagcgctggagggagggatggttgctaacgcaactctctgcagggcagacccaccagcacccgcacgcaaactacgggctggagcagtctaacagaaactctctcaaagtcgctcacgggttgccattctaggtaagatttgtgaataaaactaattctttaaaagcctgagtttttctttagttgacagttttaattaacatactcttttctttcctcttctgcagacccagcctcaccattccaatgaagacatcaattaacccatgcacagccgctacaaacggggagctcattgcctgcagggaaggaccctctacagagagctacctgggggctgggaagcaggaccccaggctgagtcctgccttttggtagtgccccgccccggccaatgcggctgttatatcaaagtacataaaagtgaaggcaaagggtgtccacgtgggatagactggcatagcttcctggccacccatggtgctccattatctcttcgaggaccccttctccacgagaccctccaggtctggtcctctatcgtccagcccccattctcttctccatcactgctgctgtgtcccagatgaccttaatttaatcttcacatatttgaaggacagaatcatcggcctcacccactaattattattattattattttattttattattattattttttgagacggagtctcgttctgtcacccaggctggagtgcatcactgcaagctccgcctcccaggttcacgccattctcctgtctcagcctcccgagtagctgggactacaggcgtccgccaccacgcctggctaatttgttgtatttttagtagagacggggtttcaccgtgttagccaggatggtctcgatctcctgacctcgtgatctgcccgcctcggcctcccaaagtgctgggattacaggcatgagccaccgcgccaggcctagacccactaattatcttttatggcacaaactctatgttttacttttgcccaggctggaatacaatagcggcatgatctccgctcaccacaacctagcctcctgggctcaagtgatcctcccacctcaacttcccaagtagctgggagtacaggcatgcgccaccacacttggctaattttaaaatgttttgtagagaagggtctcactaggttgcccagactggtcttggactcctagacccaagctatcctcccaccttagcctcccaaagtgctgggattacaggaatgagccactacatctgacctcctttgcttcttttaaagacatagtttggaatttttttttttttttttttttttgagacagagtctcactctgtcgcccaggctggagtgcagtggcgccatctcggctcactgcaagctccgcctcctgggttcacgccatccttctgcctcagcctcccgagtagctgggactacaggcgcccgccccacacctggctaattttttgtatttttagtagagacggggtttcaccgtgttagccaggatggtctcaatctcctgaccttgtgatccgcccatctcggcctcctaaagtgctgggattacaggcgtgagccatcgtgagcagcctttttttgaggagtctccaactgtcacccaggctggagtgcagtggtgccatctcggctcactgcaagctctgcctcccgagttaacgccattctcctgcctcagccttccgagtagctggaactacaggcacccgccaccacgcccagctagttttttgtatttttagtagagacggggtttcaccgtgttagtcaggatggcctcgatctcctgacctcatgatctgcctgcctcagcctcccaaagtgctgagattacaggcgtgagccactgcacccggcctggaagttattttttaaaaatcaattgtttctttctctgtcatcccagcaggagtgcacaggcatgacctcagctcactgcaacctccacttcctgggttcaagcgatcctcctgcctcagtctcccaagtagctgggactataggcacatgccaccacatctggctaattttttttctttcagatggagtcttgctctgtccctcaggctggagtgcagtggtgcaatctcagctcactgcaacctccaactcctgtgttcaagtgattctcctgcctcagcctcctgaatagctgggattacaggtgtgtgccaccacgccggggtaatttttgtgtctttagtagagacagggtttccccatgttggccaggctagtgtcaaactcctgacttcaggtgatctgcccgcctcagcctcccaaagtgttgagattacaggcatgagccaccacgcctggccaaaccaccctaatttctaccagccagatgcagatccttaaaacaaccctaggaggtatttcaaccattattcccttttaatatctgaggaaatggaggcacaaagaggctaaatctctggtctgggcagcctggcaccaaggccctgtacctaaatggtttattcaaacatagaagccctatctccttgatctatgctcttttcactatttctggcaggtttcttaccaaatatctggagttgacaacaaatgtgaaaactgaacagccttttctgacaggcaaggaagaccaaactgccaattgccaatgtcagatgttctcaaagtatggtccagagacttctgggagtccctgagacactttcagtgggtctacaagttcaaaactattttcataataaaactaagataccaattgacttctcttgcattgtttctcaagtatatagtggagtattcaaaatactatattatatgtgacatcacaacagcatgaatgcagaagcagatatgagaatctagtttttttgtgtgtctttgagacaaggtctccctctgtcactgaagccagagtgcagtggcaccatcacggctcactgcagcctcaaactcctgggcttaagcaatcctcccacctcagcctcccaagtagctgggaatataggtgtgtgccaccatgcctggctaattttattttttaagagatggaggtaggccaggcacagtggctcacgcctgtaatcccagcactttgggaggccgaggcgggtggatcacgaggtcaggatatcaagaccatcctggctaacacggtgaaaccccgtctctactaaaaatacaaaaaattagccgggcgtggtggcaggtgcctgtagtcccagctactcgggaggctgaggcagaagagtggcgtgaacccgggaggtggagcttgcagtgagccgagatggcgccactgcactccggcctgggccacagagcgagactccgtctcaaaaaaaaaaagagatggaggtctaggcagggcttggtagctcacgtctgtaatcccagcactttgggaggccgaggcggatggatcacctgaggtcatgagttcaagaccagcctgaccaacatggagaaaccccgtctctactaaaaacacaaaatcagccatgcacggtggtgcatgcctgtaatcccagctactcgggaggctgaggcaggagaattgcttgaacccaggaggcggaggttacggtgagctgagattgcgccactgcactccagcctgagcaacagagagagactatgtctcaaaaaaaaaaagtgcacacctctctggtttttagtatgtttattacgttacgcagccatcatcactacttcattccaaaatatttaatatttccatcacccccaaaagaaactcgttatatctattgctgtagtgccagctcctcagcccctcaccatcccctggcaaccactacttagatgtcctttttatgtctatgggttttttactgtaatttttaaattcattaatgtcaactttaatttagtttcacttcacacacagtatatacggccaggcctggtggttcacacctgtaatcccagcactttgggaggccaaggcgggtggatcacttgaggtcaggagtttgagaccagcctggccaacatggtgaaaccctgtctccataaaaatacaaaaattagctgagcgtggtggtgcacacctgtaatcccagctactcgggaggctgaggcaggagaatcacttgaacccaagaggcagaggttggagtgaaccgagattgagccactgcactctagcctgggagatggaagtgaaaccccgtctcaaaaacaaaaaaacaaaaaccctcatatacacaaaacatctttggaggcctcatttttaaaaactgtagtgggatcccaaggcaaaacgtttcagaaacactgatctaagatttgtgttttttgttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggtacttgagcccggcctgggcaaggcgggtaccgacgtctggagtttagtgggagttatgtgtcggagtgtggtccaggctctgcgggttgtcgcggagaggcggccatggcgcaggggcggggagagggggacggtgagagtgtggggtcgcgagccggtcgccccgcctggctcctgccttctccctgtttcctgctctccccttgggtcagtagactcgggtctccggtccaggctcttggcttgaaccccgcgcactttttctttgtgagcttcggtttcttcgtctgtgaaacgggggtcatggcctcatccctggagatcacctgaataagcaagagaagagtggcggacgctctagccacgaggacgagaagaagggagccggaggcgtgtattgggaagggttctgtgtgggacatggtgtttgggtgcagagacatccctgagagatgcaagaggacgggctgaggaacagacccggctgctgctgggtttgagttggcagcgtaagatgctctgcgattacaggaaaacgaaataaaagactaaaatttcctttcactctagcatggaagtgaatgctattttagggttggaaaggctgttaggacacccaaaatcttgtatgtgagtatttgtttacatgtgcctctctaacccggagacttaatcctcgttagtgatgatggtgagcgccatagtaattcactggagccctcgttagcctcgtggggaaacagacatttaggagaatgcctaacacatgtagagctcttgctatgtgccaggcacagttgtaggcattttatggtggtgaaccatttattgtccacacaatgctatcaggttgttactattactgtctttgttttacacaggaaactgaggttagtttgttcagagttaacacaactagtaaatattggggcttgaattcgctctcaaggagtctgagtgtagaacctctgctcttaaccattatgcccaagtacatgttatccctgctggctgagcacagtctccccttacccttcgaagatgcactgtgtccggtgcatggtagatatgaaaatgcctgaatgaataatgtcccttcctcgaggaatttacagtctgtttcaatagagtgtcacatacgtagatgtaatacgaaacacaatgagagatgtgtataaactgagggtgtggaatctgaagtaagcccttgagtattctgggaggacttcattaagggagtgaatgatacttgagatgggtttcaaaggttggataggagtttgccaggccttgactaagaagacaagaacagcaagtgttttcttatttatgatgtaagatgctctcttagctcaatttcctcatcaataaaagggagaagagtgaatgaaatttaggaattgtgaaagaagggaaaattaataattgctagcctggtccaagctcaaggttgcttttatcatgaaagggctagactcttgtgcagtaaataattgtttacatgtggccctcccctcttccctcctaccctggactgtgagccctggggcaggaatggccgtgagccattttcatgatggaaatgaacaagccagtgattagtagtttattcactaaatcttaatttttttcagcaaatacttcttgagggcctactctgcgccaggtgttggggttagaaaggtgagcaggataaaacttgttctcacagttggcagtcaggtggagaaagtgacaaacacgcaatagtggggtgtgacaaatgcttatggaggggctaacatgagctgtggttgcacctgataaagccttagtgtctaccaggaaagggtttttggttttgttttttaagaggagttaaaatgtgtttaccttagtcactccagggtggggtggggagcaatgcagatattctagggagagagattaacgtggacaaaaatccaaaggtgcaagagaacttggagttttgtaggaagtgaaggaaattcatcatgactggtaacttacactgcaaggaaggaaacagagggaatgactagagggcagggagacaccttgctaccaccagcaaggaaggctgtaaagaccatgaccttgggcagaggtagtgcagtgggagtggagagaagtggacttgttcaagagagatttaaagagatagacttgacagatgttaatgatgaactgatgtgggaggtaagagacgttggagttaaagactcccacttttggggttggtgccattcatttacatcagagatcaaaggaggaggctgcagagagatggggaaggagggttcagtttaggacaggtggagtttaagaggagccgtcggctgggctcacgcctgtaatcccagcattttgggagaccaaggtgggtggatcacgaggtcaagagatcgagaccatcttggccaacatggtgaaaccctgtctctaaaattaatcaaaaattagctgggcgtggtggcgtgcacctgtagtcccagctattcgggaggctgaggcaggagaatcgcttgaaccgggaggcggagattgcagtgagccaagagcgccactgcactccagcctggcgacagtgagattctgtctcaaaaaaaaggagccgtcagggcagccgttcagaacgtgggctgcagttgagagctcttgtgcagaacgtgcaataggacttatcagctgtaagatgttactgaagccaagagggcgggtgacctgcctatgaaatgaatctgagtggtctcagctcggggcaactttgtccctcacaggacatttggagatgtctggagagatttttagttgttacaacttgagggtgagggtggagaatgctactggcatctagtaagcatatgctaacagtctaaatgcacaggacagccccacaacggaattagccagcccgaaatgtcagtagtgctgaagttgagaaatgctggtctagagaaaggatagacggatcctaggatgaggagtgaacagaaaactaggtaagacaaccaggaaggtggggggcatggaaatgaagggaaaagtgtgtttcccaagagtgtcgcatacttctgggaggtccaacaggattgaggctgagtatgcctactggatctagcactagggaagtcatgggtgaccctgctgaatagtgagggcagaagcaagttgcagggatggaggagtgggtagcaagagaaagggtgtaataataacagctaaggactgagcagttgctgccaggcactgtgctaaacattgtatgtacattattactttgaatcctcacattcttatgagatgcaaagatgaaggggctaaggaggctgaggagggttcatataaagcactttggagttagatcttcatttgaagctgtcagtcactagctgttgaccctgggtcagtcagctaacccctctatactgaggtttcctcatctggaaaatgggagacggacattaaaaagcacttactggcctttcaccaaataccagataatgttctaagcacttttacatgaatcaccttaattactctcctaacaacctaacaaagaggtatttttattcccattttgcaggtaaggaaattgaggcactgggatggaaaataatttccctaggttacttagctagctgtaaatggcagagctgggatttcaacccaggccattttaccttgaatgatgaacctacctactatgtgctagtcactgtgctgccactttatctggcacttatttcaattatcttttttttttctgagacacagtcttgctctgtcacccaggctggagtgcagtggcgcaatctctgctcactgcaacctccacttcccgcattcaagcaattcttgtgcctcagcctcccaagtagctgggattacaggcgtccaccaccatacctgactaatttttgtatttttagtagaggcagggtttcaccaccacgctggtctcgaactcctgacctcaggtgatctgcccaccttggcctcccaaagcgctgggattacaggcatgaaccactgcgcccggccaaattctcaaaaagcccaaggcccacccccaaccttattttacagacaaggaaaccaaggtccaaggtcacaagctaataaatgtcagagctggaattgaagtccacttctgtctgaccagagtctacactctacctcattactgacttccccttccccttagattgatcactgcgcttccttaagtgcttctacatctgccatctttctgttctcccaaaacatcctgtgaaagcaggcagaggaaggtcctgcacatatttttgacaagtcagtgcacctcagttttctatctgcacacatgcatctgcaggtttttacctgcttgctcctgactttcaggattgccatgaggaacaaatgagaactagatgtccaagcgctttgctaccataacgtgagaaatggtattagtagccccatttatcagatgatggaatggaggttcagtttttgaaacagcccgtctgcttatgggcatgccttacttaggtgtaagattctttgtaggggtcatctgtctgccttttcgtcttgctgtttctgtgttggctacgtataccagccagccttttgccttctgcgaggcctatggctcctagcaaccagctgctaccaccagcaaggaagggaaagagctgccaggagctttcccagttggtacataataaggaagcaatacagcatcctattaaaagcagatttttagaggggaagagatctaggtttgaattccactatgagctacagtatgttatcctccaacgtaaaatagagtaatactctccttagatattttcagctcatttaacccccacaaaaatagagggcttttctttttttaagttttatcttcattgtgttttctgatgataaaaataattcagttgccaattctaaaacaaaacaaaacaaaaaaaacttaatcatctgaagcaaattcagggttaagtttacatgagagaagaattgcatgtcggtggtttttgcagaacccacataattccccatcaagagaagatcatcattaacagtttgcaggggtgggtgggtctgtgagtatacatacgtctcaatacatattagaaaccccagttaagaaatggaggtacaggctgggcagggtggctcacacctataatcctagcactttgggaggccaaggcaggcagatcacttgaggtcaggaatttgagaccagcctggccaacatggtgaaaccctgtttctactgaagatacaaaaactagccaggagtggtgttggggacctgtaatcccagctactcgagaggctgaggtgggaggatcgcttgaacctgggaggtggaggttgcagtgagctgagatcatgccactgcactccagcctgggtgacagagcaagactgtctcaaaaaaaaaaaaaaaaacacacacacacacacacacagaaaattctggcagttcgctctctggtttaggtttcggtcagatgtcaacccttttaatccttagaacaaccctgtgaggtgctggtctacttcacccttggcaattcaaaacatgtcctgggccaggcatggtggctcctgcctataattccagcactttgggaggctgaggtaggaggatcgctggagcccaggagttgaagacaagcctgggtaacctagtgagactccatccctctctctctcttttttttttttaagtgcccagcatcacctgggagcttgttagaaatgcaaaatctcgggcatcaccccagggagacggagaccaaatccacattttcacaagatcctccaggttatttgtgtatacattacagtctgagaagcctgctatacacctgctgcacttgcttgtagagcagggaaggcactgaggccaagcttaggggtgtccacaacatgaccagggcagaatgagcttctccaacatgagctgtggcccccagcccgcccagcaaagttggtccctgcttcttctgctaccaccatacttcatgtctaaaagtgatcttctctcctccaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtaaggttcaggccactcctcttccctcatgccatcacctccctctcctaggcctgcccacgttcccctgcctccccaggatccttgctccctccttagcaccgctttgttccctgagccttcactgttcacttaggaaatgttgacaggtgcccccatgatgggccctctctgggatactgtagggagagatgagaggttgaatcaaacatacattactgtgcacagagagggaggagcaatgagggtgagcaggtgagccccaagtagaggctgggggacatatcaggagggttggcggaacacagacctgccagccagcctacccaagctgcagctgggtagtgtcagagaagaccacccagatttggggacagaactcagaagggcagctactttataatcctactggggatttaaagttcaaactccttggcctgtttttctaggcgggggctggcaaaccatggcctgcaggtcaaatctgatcaggagtaagattttcagtaaataaaattttatcgtttatttacatattgtctatagctgctttctgactacagtggcagagttgagtagttgtaaaaggaacacatggcccacaaagcctaaaatatgtacaatctgcctttttacagaagtttgctagctcccatactaggccgttaacaatttgggcttcagtttctttccagcctcattccctcaatatatattaaactccctgctgtggcctaagctgcacttctccaccagaacgcagtggataggtgattggtatgtagagtctagttcagtcataagcagcatcctctattttccccattatggtgtaaaatacaatgttctacacatgtagccatttgaaaaagactgggaagccttgcttttttgctattcttgattctcagaatttctttctttggtcaaaatcttccttccttgagcagaatcagttactcctttgagagtgtgttcttatcttcgtttcctaaatcacagcaaagtgtggatatctatcctaccagactgaaaaactccaagagcagggatatcagatctatctctgtattcctaacaccaatagagagatgaggatggagtaggtgttaggtggatgctttttaaggtctttgtacaagaaaggggatagagacgttctcttaaatccaaggtccagatgagagtagaatcccttacccacccccaccccactccaccccttacacacacacacacacacacacacacacacacacgctaatttctttctttcttcctgcaggtttgatgccttctatggggagaggagtactcagcaggacatctatgcaggttcagtgcagcccatcctaaggcacttgctggaagggcagaatgccagtgtgcttgcctatggacccacaggagctggtgagggagccagaaaagaaacagctatgggtcagaaagggctggggaaacggagaggaaaacctcacagttttctccactctcttcccagggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtgaggccccgtgctggttgggagaggagcaacaaagggtcaaagtaagacctggttctagaacatgaagctctgctgtagcagggaggtaaggtgagacctagaaagacagagactggggtagcagatggtacaactccgagaatagaacagagaaaggaaactgatccccaggaagaaacagcctctctatggagaattgcccttccccttcactgcttacacaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtgaggccgcagacaggggcgaggacctgggaagcccaggagcctgagctaagcacgagacctttgttcttacccccaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggtcaggcccacctgtctcagggaagaaggggctgcagaaggaggttctcaggcctgctgtggggtggggaatagcagttgaggcataggaaggctgggcttctgacccacccactgcctggtctcaccctcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatggtgagaactgggggaggcaggagtggaaacgctgggtctggaaattagggagtttgttgaaaccaccaagcatcagcacagaggctgaccacccccaatccctctctccaccccatcctccaatcatctagccttgggacctgttaagctgtctcagaaagaattgcttggtccaccagaggcaaagagagcccgaggccctgaggaagaggagatcgggagccctgagcccatggcagctccagcctctgcctcccagaaactcaggtgagcagtggggccttgggtgtatccccttcctgatgtatggcttagcagcagagctgcaatgcccgtcagatccttgagcagagagctgtgatcttgttcctctcccattaaattcaccctaggccggatgcggtggctcactcctgtaaccccagcactttgggagactgaggttgggtggatcacctgaggtcaggagttcgagaccagcctggccaacatggtgaaacctcatctctactaaaaaatacaaaaagtagccggatgtggtggcatgtgcctgtaatcccagctacttgggaggctgaggcaggagaatcccttgaacccaggaagcagaggttgcagtgagctgagattgtggccattgcactccagcctgggcgacacagcaagactccgtctcaaagtaaataagtgaattcaaccctggctaggcacggtggctcacgcctgtaatcccagcactttgggaggccaagacgggtggatcacctgaggtcaggagttcaagaccagcctggccaacatggtgaaaccccatctctactaaaaatacaaaaattagccaggcatggtagtgggcacctgtaatcccagctactcaggaggctgaggcaggaagaattgcttgaatctgggaggtgaaagttgcagtgagccaagatcatgccactgcactccagcctaggtgacagagcaagactgcatctcaataaataaataagtaaataaataaattccccccaaattctactccattgaatcactaaagtctaagattaatctctcctcagtgctgctgccttggggacctaaggaggcctcctcctggggatcctttccattttccaacccctttagccttcagcaaaacttctcactttgggacagctgtttcaaggatgagcatttttgcttctggttcaaggagtgatctggatcagatctttcagatccatgagagcaaagcaaaggagacttggaagagctgtcctgctgagaccatctggtctgtgtgtcagtgcccagcttctccatgactctccggggagccagctgctgtcctaactgcgtctaccctcaatccagataaagcctctaaactaagtcctttgtgtcacctcctgccccaactccaatcaccccacctcatggcccagtatgtactaatcctcaggtcatctctgttcaggggtcttgctttctgtgtctggccacttagcccttgcgctattccctccaccccccaggagccagttgcagttttaactttgccctgtttctacccctagcccaaataaagcctgtgaactactaaacagaggtgacctgaggtggccaagggttagtgcccactctgtcccagggggctactgtagttaaggaagatgccacacacaagaagatgcttgtgcactcatgaccccatctctcagtcttgtctttcccaaaccatctgtcagcactccccactgctgtgtgcacccagaaatgtgcacaggtaagctgtcagacaggcactctgagtaaggggaagctcagagttgggcacatcaaacccagcagacccagagcttgggggcctcacaggagagcaagtcagatgggaacatcagtatatgataccaggtggagaattcagaatcaggaaggagtagctgctgctgctgtgagagtcaggaaggaagagatgacttctagtgtttgcccacgtatgttctgatcctgtttttccaaggcactagcatggaaagcacaggagtgtccctgtcctccaggagccagttcacagcataggaagggagatgcattgttaagcttggcgtcatgggaaaggtggcatcaaactgacctggaaagattattgatacagatgtgaggaggtgtggggcaagattccaggcaaaataaatgaatgttagacgttgctgactgggcgcagtggctcacacctgtaatcccagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgcttaagcctcaggaggccaaggctatagtgagctgtgatctcaacactgcactccagcctgggtgacagagcaagaccctgtctcaaaaaaaaaaaaaaaaaaaaaaaaagaatgttaagccttaccgtgctcagagtcagtcaggactgcttgaacaggccttcccagctgcccacagcagggaagcttggcagctgaggtcttcggtggatttcaaagccctgctaaagatggcatcctctgtgatgttttccgcaactgctcctccaaatggataggcactgtcctggctgtcaccttattatggtctcttgatttcctcagtagacagtgcctccagggcagggcagtgtcttaggtctctcatacctggcactcaagtgttcgcctgatttcctggcatccccgagcagtcacttcacctgatgaagacactgcacccagagaaactggatgcctagcaagttaacattaggttctggagctacaggatataccaagttaaggtgtggtgaggggagtcctgctgctgtaggtggtgatgagggaggaggtaggtggggagcaacttctttttctgctcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgaggtacgtgttttagggatgtgggagctggattcctattggccttgagaagcaatccttggatcttcagacagggaaggacactcaggctggactagagtccagttttctcccaataccggaagttctccagcttctgcttgaatgtccttaacatggctgaactttgacagacaattgagaccagatgtgagggtgagaagaaaaagttcaaagtaaaagcaacaaatgttaaacattacatttcctaaagcccagctcaattaattgaggactgtgcttgaaaagcctttcccttcaatatttgcagaggcttgttccacctctgggtagccccctaatcacagaaagcccttaattatgttaggctccacctgtctcctggtaacctcccactggtcctagccctgccctctgggggctcagagccttgcatactcaccctggtaacccactcccttcaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaagtaagtttgactccaggggctggggggccaaggcagctgagatcctataagggaggaagtgttaggagcagctgtctccatgtcattcatattctcccaccacataccagtcccagggaggggtgaggaggctctgaggcagtgctgggggtgctctgccctcgggtgtttaggacagtgggatggacaaacgagtagaggattgaagataatgcaagactgactgaaattcctttaaatgcgggtataaaaaaggtcatgtggaaacacaacaggttaactctggatggaggggagctggggaatcagaaatggaagaatcgaagggctaccagggagggtgaaaagtaccctttgccctgactccaattctcgattcctactttcagttcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtgcttccgcctgatttttggggctgcgggggcgggaccggggtgtgaccgcctcggggtgggccgcgagcaaggcaggcgactccactgggcgccatcttcggggaacgactcagcgcaggattgtaaatacaccgctggggtggggcggggaggacggtggcctgcaggacgcaaaaagcggaagccgaagcatgaggcctgcgaccgttaggcgggcgcgcgctcagggattagccccgccccgtccgtgcccccggcgcgcgcgctcccccattctcccgctcggcaacgacggcggccttgtgcgcgtgcgcgcgaaataacggccgctggcggagggagggggagtggaatcgttggcggggggaagaggagagaagccgccctgtctcccgcgcgcccaccacctgcgccatcgtcagccaatcagcagccgtctcaggggtctcgcgctcggggcgactcgggctgctgggtggctcccccgtccctcctcccgccagagtccctctcgcgcctgcccctcccgctggccacgcgcgcgctcgcgctagcgctcgcgcccgctccagcctcttgtgtgtcctcgcgccccccgcccgccctccccgcgcgtagtgtgctccgcttcccccaccctccacctcccccctcctgcccgccccgcgcgcctcctcccgggttccccctcccccaccgccgccgcctcctcctcccgccccagggtgagcgcgagccacctccctccctccctccgccatggatcccagcaactggagcagcttcatcttccaggtaacaactccctccccccgcccccacccccctgcccacaccccctcctgcccgccctccctcccgtcccaccccccctccgcgcgcccggtgcgcgcgcagctgtccccctccctccctcgcgccctcccccgccctccccgaggcgccggctgggcgcgcgcgcggcgggggccgaggctgctccctcgctccccccaccccgccccgccaggctccaaccgccgccgccgccgccgccgccgcccgggcccccgcccccggccccggccccgcggggcctcccgcccccacccagggggcgtcgccgccgccgtcgccgcggcgctccgcggcccgcaaggcgccctcttttcctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggtgagtagggccggccgcggcggcccgggctggggggggacgcccgcccgcacccgcggcccactcggcgccttgtctccgcaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccaggggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgaggtaggaagcccgcctcctcctgtcttggttttcatgattttgatcctcatggtagctgtctgagtcagtctctcagaccccctttttctctctcttctttttgcctttttgctccattttctcatcccttcttcaaggcctcatcatgtcactcccatttcctacagatcaaagatccccaaggctctgattcctttaatctcttgctcccccctccccagcccaccaagctttaactctcctgtgacaccccccacgcccctcccccctcctcagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaagcgggagtggaacttggctgctctggggaaggagtagtcaagaaagccagttccaggggtcacaaggcaaggtttccgctgcgcagccacaaggtcttgtctccagctcctggggcaggtggagtacacgggccgggctttaccagcacgcaccctgcacgggtagcagagaaagctgccttcagtcagactcaccggttaactgggttgagaccgcggggcactggagggaaggggacacagccgtctctgctgagggtcaaccctgcaagtggctaggagtcagtgtctcgtcatcctgggagaggtctcccggccatggagaatgagttctgtaggtaccaaggctgagaagcgggcaccacacaagccaggccccaggctcagggaggggctgtgtctaccagccccaacagagcagttggccccaggctaccaaggataccgtgggaggaggacagggccatctgaggagggcatcccccgcctaggagatcagccccgtctctggggtctccgcctggctgacccccgccccatcccaatccaccccccaataggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccgccccccctgtcccgggagacgccccccagccacagcccacctgctgagggggacccccgcacccaccaggcaaggcgtggggcatggctggggggcgggatggggggtgtgggggacaacggggctcaaagggcccaataggggatctcaggaaggcgagggatgcccatgtaccactcaggctagggagacttctgggcacagggaggatccttgagaactgctctgtctgggtgaggatgcaggctgaggcctctggggtccagataggaagtgagcaacggctgtgtcccaggggaagcaggctgggaaggtgtggggtgagggcaaggctcttgccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattgaatgaattgccctcactaagaactgccgccaaccccaagggtttcttctcggcctggtgtccgtcaatccagccttgctctgccctgtgaggctgtgaggttctggctccgccctccccaggggcagccttactggcggcagcacagatacagggcggggccaaggctgtggctgtggagagcaagttccaggtctctggggaattcccaactcggacaggcccagaatagcccctggaggtttgaagaggccccgtcagaaacccaaacagagctgccagacgggaatgccgccctcccccgtccacactcatggccgctgctcagcccccagccgcatccctccccacgcgcgtcacggccctgaggccatggtgggtggatgcggctgcggaaaggctggggagtccgagccctaggactgggagcagcgaggtagagaatgaaagctgcacctgtccctcatcctgggcatgggccactctgtgtttacacgggctcctctgcccagctcctcctgccccttggaattccctttcctgtccccgctccgtcctttccagggccccttttttgagccttccagcgccagtttctgccgctcctttctgcaggctccattctctccaaaccccaccctgctcctcctctgcagcctccccgcgtcttgccccatcttccttgccctcctgctcgtagagacgcctccacccggtcctgcctgtctcactggtcccgtctcctcgcagaaccctctccgtttcccccaaatccccgtctcttccaggaatcccggtgaccgttggcgggaggggccggggacttaagaaggaggcgtctctcctggaggcgcgcgtgagaaggggcagggagggggcgcgagtggtccccgggccggttgcctgggtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgaggtgagacccgggcagactgaggctgcgggtaggagtggaccgaccgacggctgacgccgggcggactgcacgggaatgcgggtgtctggagggctggtggtggtgctgggcgggctgaaccatcgggaggaggcgccagcccaccgaaggcgagggaagccccgggagaggggctgacaggggatcgaaggagataaccaggtcccccagaaaggggcgggagcgtcctcgccctaaacgcgcagcaagaaaacccgcaccgcctgggagcccagggaggaggggaggatgcagagggagtggaatgcgaatgtcgggtcctctgcccagtcggcctgtcggagtgctatttgcacagctcgttgattttggggtgctgggatctgagagtctggatcttgttggatggacccagggagagaccctggagaaggtcctgtttacaaaagggttaatcttccccagggctctccaagcagaagactttgagtagagcactcctcccgcagggatgtcccaccctaaggcaaaggaaaccccaacttttcttcctctccctagaggcagtgcaaggctggccctgagacaggaatgtggcccaattgggcctgcagtgctgagcgccctcttccctcctcaccccaagcctatctcctcctcttccagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggagtaatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgagactcgcctccaatctcggttggttcctgcgttcgtcccgccggcccggcggtgctgcctttctggcagaaccttactgggtggtatacgcatgcgacttcccggtggccatctttactgtgggctgaagcctgtgcgcttactcgcgcatgtgcaagccttccctcgctttcctcttccaagtagccttgcctagagcggagcctcccgcgccatttctgtgcgcctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgccggcctcccacgccggaggcccagagcgaagaggagagatccgatgaggagccggaggccaaagaagaggaagaggaaaagtaaaggcacacccttacaccttgtcccggggctgctcccctgatggcgggaggaaatagggaggggaaaatgtgggacgctggaacctttgaaagtggagggagggaagccagcgggggaggaggaacgggcaggggagaagcacacgtgtgggtgggagggaggaccgccctcacccttaactatgttcacctgtcccagaccacacatgcccacggaatttgattttgatgatgagccagtgacaccaaaggactccctgattgaccggagacgcaccccaggtacaaacgaagaggaaacagttgggggaggtgaagggcctcggctcagttacccaagatcggctcccctagaggcctttgcttgctgcctcagctcccacacaacttacagctgcaggagagagtattcacccagtagcaccatctttatgacttagattactaccttgtcttccttttttttttttttttttttttgagatggagtcttgcccttgtcccccaggctggagtgcaatggcacgatctcaactcactgcaacctccgcctcctgggttcaagcaattctcctgcctcagcctcccaagtagctgggattacagacgcatgccaccactctgggccaatttttgtatttttagtagagacaggctttcaccatgttggccaggctggtcttgaattcctgaccttgtgatccgcccacctcagcctcccaaagtgctaggattgcaggcatgagccaatgcgcctggccccttgtcttcctttaagagacaattataatacaaaaaattagccgggcatagtggcgggcacctgtagtcccagctactcaggaggctgaggcaggagaatcgcttgagcctgggaggtggaggttgcagtgacctgagatcacaccactgcactccagcctgggcgagagagtgagactccgtctcaaaaaacacaattacagataattctttttttaaaaaaacaactagtcattgattctggaaaattacagataattctatcatgtttcccattcccagaagtccaagtcctggcctttcaatattatctagatctgcatccctctactaccatgtacattctttaatcacaccgctggccccatttcccaccccacatgccttcctagaatttaccctcagagtcatgcctttccttttttcttttttttgaggggtggagagacagagtcttgctgtgttgcccagactggttggtctcgaactcttgagctcaagtgatccatccgcctcggttctcaaagtgctgagattacaggcatgagtcactgcacccagcctagagccattcttgatttctctctcttttacctgaacattcacaccagcagcaagtcttggtagctataagatgtacatttccaagtacctctgctagtctccactttcaataccacatccccatccaagccactgtctttcttgcctggatagttgtagtagctcctaactgggctctctgcttccagcttctgcaattcagatgaaccttttaaaacataaatcatatcactttttttttctttgagacgaagtctttctcttgctcaggctggagtgcagtggcatgatcttggctcactgcaatctccacctcctgggttgaagcgattctcctacctcagtctcctgagtagctgggattacaaggacacgtcaccacgcctagctaatttttgtattttctagtagagagggggtttcgccatgttggcgaggctggtcttgaactcctgacctaaagcttcccaaagtgcctgcctcagcttcccaaagtgctggaattacaggcgtgagctgctgcactcagccataaatcgtgtcacttttccacttaaaattttccaagggattccatcttgccagggaagagcatgtcaaaggagaatccaagcgcttttcccgccacctccagttctctgcactcttttttttgtttttgtttttggcgagtaggggagacggagtgtagctgtgtcaccgaggctggagtgcagtagtgcgatcttggctcattgcaacctccacctcccgggttcaagcgattcttctgcctcagcctcccaagtagctgggattacaggcgcccaccaccacgcccagctaattttttgtgttggccaggctggtctcaaactcctgacctcgtgagttgcccacctcagcctcccaaagtgctggcattacaagcgtgaaccaccatgcccggcctgcactcttctttgaacagaactctgttcttgtcctggggcctctacccttgccattcccctgcccagtatgttcctccctgttcttcacattacctgtgccttcctgtcaatcaagatctttgcttctcaccctctctgaggtccaaccctgaacctcaggtcctccaagacagaggcctggggacctgcatgtttaaccagctccccaagtgatgagtgaggtccaggcaggtatggtgtacaccacctccatcccttccatgtatcttaccttcctcttctccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagctgcagcagaagcagcccggaggataaaatgagaaccagctgcacacgggccctttaactcccaagccccacccctgggcttggcctgccttgccctgccgggaagtgatccccaaggcagggtgagagttccccatctgaggcgtttgttgcagctacctgcacttctagatgtgagtacattgtactagccccccaaaccccaaatcaggggcagatctttgtatcccttgaggctctctttagtcctgtcttgctttgaagggccttgcttctgctggggcagggaaaacatgtctgaatcagagtggggaaggaggatgggtggtggctttgcttttggaggtttcactttccaatagttgggagtcttctgggttttgaagtaaaggcagattaacaccaacaccggtcccccacccccctgcaactctcaggcctctctctgacttcagggtcccacctgggaaatcaggtggggaaccttacagggtcattcagaccccatcttagccctagatcggtgcttgctctactcacctgcactgtcctggggacctgggctctggcctgtcaccttgagctccaagaatgtgacctgtacccattcaggccccttaactctgacagatgagggtttcttactcctccatgcagggctgggccagctgttggtctcagtcgatcattcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagcacttgggggtggaggtgatagcgaggctgatggcccctgtgttctcagctctctgcctgggtagcccctgggtgatgggggagaggccagctgtcacgtggggtatcaggtggctctgccagaaactcccttggcacacagagcactgggtcggccctcgggtgtggctgtttgggcaggacagccctctgtatgtagccttgagcaggtaggggggccaccttgagtgggtggcccagagacagcctcagggctccaaggtaacggggtgctcaggttatcttgggtgctgccctcccaggttctgggggagcagaggctgggcgctggcccaacttacaggaaacactcacctttgaactgccattagcaccatctgggcagtacacagccccacccaggtcctctagttcttgttctcggcttagaatctttgtgtttctgcctgagaagccactgcctcctagtttgtggtctctacagttatagccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttacttaggggcgtttgcctagaacacagggtccagaggctctctcccggaaacttagacccagtgagtcagaagtgaggcctgcaaaaagcagcaggagtggggttaagaattccagcctagggctggatgcggtggctcaggcctgtaatcccagtactttgggaggcccgaatgggaggatggcttgaggccaggagttccagaccagcctgagcaacatagcgagaccctgtctctgtttgtgtgtgtgtggttggggttttgttttttttttttttttaaagaattatagctcagtcctatgattaggcaagttgagaaaatattgatgaagatcaggggtgctgaagcctggttcctggggtcgcttctgatctaggcggttcttgcctctggtgactggtgttaattggcaggagtgggaggagggaggacaagtggaagtctaggctggctgagctgttctgtctcgaaaagttcctaaaactgtgctgctttaaaaaaaaaaaaagtaatttatgagacacattctcaatttccattaatcatctcctaaagggggtaaaccaggaagccgctgggtgaaaacaggctgttggcaattcctgagtcatgtgacccattctctaaagactagaatatttaacttaaatcagtgagaaactctgtgaagttgtgtccttgtttataccaaacttcatgtgccttttcctgaacctgaagctgtgggaaggtctgggggcagggccgcatcaccgaccttacgtccaacctcaggactgcctggagcaagagccctggggttggggacaaaggaggctgcctggacctgggtaagggaaggggctggaggagaatgagtgcaattccctgcccttcacagcctgcaatcggagctgtgtttttgtttttgagacagagtctcgctctgtcccccaggccagagtacaatggcgcaatctcgactcactgcaacctctgcatccctggttcaagcaattctcctgcctcagcctcccgagtagctgagactacagttgcctgccaccatgtacggctaatttttgtatttttagtagagacgaagtttcaccatgttggccaggctggtctcgaactcctgagctcaggcaatccgcctgccttggcctcccaaagtgctgggattacagccactgcgcccggcctgaaactgatctttatcctcctcccagttcctactgtgcaccagagaccctccagtctctaatacctttgacttgaagagcagtcatttttttttccttttcttttcttttcttttttttttttttttttttgagatggcctcactcttgcccaggctagagcgcactcgtgtgctccatttacggctcactgcagccttgacctcccaggcacaggcgatcctcccacctcagcctccaaagtagcagggaccacaggtgtgcaccaccacacctagctaatattttttatggtttttatagagacagggtctccctatgttgcccaggctggtcttgaactcctggcctcaagtgatcctcccatcttggtctcccaaagtgctgggattacaggtgggagccaccaagcctagtcaacagtcacttttattctcacttcactggagaggaaggctcagaggctagtaagtggcccaggagcatgctggcagtgataaaacctgctggagtgacattttcccactggctctcaatcctggatatatattaagagtcagaggccaggcgcggtggctcacgcctgtaatcccagcactttgggaggccaaggcaggcggatcacgaggttaggagatcaagaccatcctggctaacacagtgaaaccccatctctactaaaaatacaaaaaaaattagctaggcgtggtggtgggtgcctgtaatcccagctgaggcaggagaatggcatgaacccgggaggcggagctgcagtgatccgagatcgtgccactgcactccagcctgggtgacagagcgagactcgtctcagaaaaaaaaaaaaaaaatgagggagaactttttacaatagcaacgggtgaacctcacccagaccaattaaatagaatcaccggagatgggtggctttaaaaaaaggtctccagaaggcctggcgcggcagatcacacctgttatcctagccctttgggaggccgaggtgggtggatcacttccagcctgaccaacatggcgaaaccctgtccactaaaaacaaaattatctgggtgtggtggcggacatctgtaatcccagctacttgggaggctgaagcaggagaattgcttgaactcgggaggcagaggttgcagtgagccgagatggctacactccagtctgggcaacaagcacgaaactccatctcaaaaaaaaaaaaaaaaaaaaaaaaaaaaaacagatttccagatgaccagtgtgcagcccgagccgagagtctgctttagaccagagctgctcagactgtaatgtgcatgcaagtcattgagggtcgagttaaaatgccagtagattcagtggctctggggtggggccccaggctgtgttgctatcaagcctccaggtggtaccactctactcactgcagaccccgtaggcagtgtggtcacttggtcaattgccatttaagactcactaggggccaggtgtggtggttcacgcctgtaatcctagcactttgggaggctgaggcaggcagattgcctgagctcaggagtttgagaccaccctggggtgaaaccccatctctactaaaatacaaaaaattagccaggcttggtggcatgtgcctgtaattccagctactcgggaggctgaggcacgagaattgcttgaacctgggaggtaggtggacgttgcagtgagccgagattgtgccacttcactccagcctgggctacagtctccaaaaaaaacaaaaaagagattcagtatatcagctactcacagttgaccctgaagatctctgggaagtagtgactcatgactcgtttatttattaagttttgctgtagcagaagtttacttttgagccaagagtctgatccggtctccctcttttttttttttttctttctttaaagagatggggccttgctatgttgcccaagctggtcttgaactcctggcctcaatccatcctcccaccttcggcctcccaaagtgttgggattacaggtgtgagccacctctctcaggcaagagcccctcttttaactagacaatgaacctggtttctgctttggacaggctatttagttcctgcttatttaccctcatggtgggagagaccctggtgggatttggggtgaaagctggctgtggttcttgcaggagcctcatgacacctgagggaggtgtgatcaggcaagactgggcctctacactgagagccgactagggcaggtctcagaagcagagactgaaggaagttgggtggatgagtggatctggggagcaggggccaagcctgagggctgggcagagccttccaaaggtcaacacaatccttgctattgtcttttgagggccctgatctattttaagtaaaatgctctaactgcgcatgtcatctggaaggaaaccacaaaaaactcaatctgagacttgtcaccaatgtgctgcctgagtcaaagggtttccctggctcacctccatagatggcgagggtagaaggcaagacctgtcctgggtggtctaggcagaaggcccaggtttagggcatggcaggtgggtggtcagggaggtgaggtggggtcctggtgctgatgcaggggcagttgccgagggcttggcctcagaacaaggcaggagtccagccatgaggatgactcttgctgagtcactgagctgggcgaggcattcagaccccctgactgggcccagctggggcggcagatggtggagaggcctcagctgtggggggtgttggggagattatccactgatgaaccaaatggaggctgttcccagagcctgcttccaaccttgcacggccttctagagttcaaatctttcctgggggggcctcagagccctgtccatacctccgctcacagccccagcccttcctcttctcccatctggtttcctggccaggtttcggccctgcggagaaccctccaagggagcagtggaaaaagcttcacttggcagtaaagcccctacttgctgttccatccctgcagctggggtgaaataagccactgaccagtaaacaactgaggcttaaaccagcatgccagctcaggtggggagcccccagcactggttatattccctagattcctcactggataggaaagttgggcctcaggcactcttccctcctctgcagtcaaacagtgcagatgaagagccaggctctgttcccagtgctttatgtgctaacttggttgataatgttatccattctcattttgtagatgaggaaacaggcacagggtggtcaagggacttgttcaaatcactgatcccataagggtgagagccaagatccaggcatcctggctgggtgcggtggctccacctgtagtcccagtgctttgggaagctaaggctggatgactacttaagaccaggattttgagaccagcctggacaacaaagaccttatgcctacaaaaaattaaaaattagctaggtgtggcagtacgtatctacagtcccagctactcgggaggctgagatgggaggatcccttgagctgaggagttcaaggctacagtgagctgtgatcactgcactccagcctgggcaacaaagtaagaccttatctcaaaaaaaaaaaaaaaaaaaggccgggcgtggtggctcacgcctgtaatcctagcactttgggaggccgaggcgggtggatcacaaggtcaagagatcaagaccatcctggtcaacatggtgaaaccccgtctctactaaaaaaaaaatacaaaaagttagctgggcatggtggcaggcgcttgtagtcccagctacttgggaggctgaggcaggagaatcatttgaactggggaggcggaggttgcggtgagccgagattgcgccactgcactccagcctggcgacagagtgagagtccatctcaaaaaaaaaaaaaaaaaaatccagatctaggcattcccagccctctggactctaggaagtcgtctttccagaacagagccccgtattgtggagcaactggggggtggaatcaaaggtgagcaggacagggctataggaagaaaagacaaggtccccataagagtggcgagaggaacagagccaggacatcggaaagcaagcccctgtgttcccaaaccgcagaagagggagctctgatgttagacaagccaccctcctacaagcgaagggaaagtaactttgagcaaaaatgagcaacagaaaatgagatcaaggtcagatctcatacaaagttgcaagatgaaagaatgagcagcagaataacctccctgtgatgtggaaagtgtgccaggaaaacagacccaaactgtaacctctttcagaatgaggcaaggcagtgaggaaactatgtgaaaacacgaaagcagccgatcagagttgtaagcccgggcagtctgggttggaatgggtgccccgagccacgggaccatgatgcctctctagaaagacaggaccaggcattccaccagggttctagtcccaacagcaccactaacttgcttgtggccctaaaggattcattgtccctctctgggtctcaactatttagagctctactgtccagtatgggatcaaccagccatatttggcaatttaaattaaaattagctgggtacggtagcgtacccctgtaatctcagcactttaggaggctgaagcgggaggattgcttgagcccaggagttcgagaccagcctaggcaacatagcaggaccttgtctctgcaaaaaaaatgaaaaaattagctaggcgtggtggcacatgcctgtaatcccagctactcgggaggctgaggtgggaggatcacttgagcctggaggttgaggctgcagtgagtcatgattgtgccactgcattcctgcctgggcaacagaacaagaccttgtctcaaaaaataatttaaaaatttagttcctcagatgcattagccacattttattttatttttttccaagacagagtcttgctctgtcgcccagggctgtagtgcaatggcgagatcttggctcactgcaacctctgcctcccaggttcaggcaattctcctgcctcagcctcccaaatagctgggattacaggcacgtgccaccatgcccagctaatttttgtatttttagtagagacagggtttctgcatgttggccaggctggtctcaaactcctgaccttgtgatctgccgacctcagcctcccaaagtgctgagattacaggtgtgagccagcatgaccggccattagccacattttaagtgttcaggagccacatgtggatgtggctagtccaaagacagcacagatttagaatattctcatcattgtagaaagctctattggacgctgctgagtaaaagggtttttttggtttggttttgagattggagtctcgctctgttgcccaggctggagtgcaatggcacgatctctgctcactgcaacctctgcctcccaggttcgagcaatcctcctgtctcagcccccctagtagctgggattataggtacccgccaccacaactggctaatttttgtatttttagtagagacggggtttcgccatgttggccaggctggtctcgaactcctgacctcaggtgatccacctgccttggcctcccaaagtgctgggattacaggcttgagccaccacgcccggccaagttaaagggtttttaaacaagagctgggcagtgcaatggcatagctgtaaggcagcagggggtggtggggactgtggtaggtgggaaagcttgtgttccatctaaatggggcagctgctgcttgactgtaggctgtattgctggtcttctaattcttcaagtgaatcaggaattgggattttgtgaagactcacaatttctaaacaaaaagttgaagttttacagatcgtggggctcaagtataactcctcttgggctgtatccagccttgattctgtaatctgtggctcctgcctgtttttcctcggccaggccactcccttcttcccctcacttatatttttcacctggggttggaggctgggtagatggtggaattgatgaggaaccacttttttttttttttttttgagatggagtctcactctgcctctcataatgctgggattacaggcatgagccactgcacctgtcctggccagacatttttgaggccaccaccagacaaaagaggctcctcatcggccaggtgtgatggctcgcctataatcccagcactttgggaggcagaggcaagaggattgcttgaggccaggaattcgagaccagcctaggcaacataatgagacctcatctctccaaaaaaaaaaattagctagacatggtggcatgtacctgtagtctcagctacccaggaggctgaggcatggcttttgtgagctatgattgcaccactgcactccagcctgggtgacagagtaagactccgtctcaaaaaaaaaaaaaaaaaaaaaaaagtctgacctgagtctcttaaggatgaggctctggagcacctagtaaacttggtcccatttgtgtgactcaaagggacatgtccaaagtccaaagtgctgggggcaggggtggggcttaggtagggcatgtgacattcctgaacaggccaagcactgggtgaaactactcaggattcagaagcaggtgggatgggtgggtggaacatgataatcatcccccttctccttcctttccaccctacccttgctcacaactgcaggagctgaggatgggagagaactggggacgagggggccagagtgatttgcagtgttagtaatgcagctggttctatggaaggctcagttccatctgggatccctttatgagcagtggactaggtcttcacattcagcccaggattactaaagcataggaaagaggcagggaacatagacacagctcatgtaaacattccttttgtttatggccgaatcctagccactggactacctgaggcatacagatattctttggctatgggctgacatttgaatacagctggggcctcaggattctctgaaataaagggctgcctccctctggaggagccaggcagctcctcagagcagctgcccattgcgtgctggacaaggccatgtcaccacctccatggctccccagtttcccagcttgctgtatctctccaccgtaagagactgggagcaccttgatctgaagctctttgcagtgccggtggcagtgtagggggaagtagttgatgggagtgagggaaaggaattggcaaggaaccctgggcctctgtggctcactgcatcaagcagttcttggcaaaggtaaggtcaggatgggctgtgtcgtcttgggtggggtgaagacagggagcagtgggcatgcagatgcggacagggaagggtgcagtggcctggctggaggaggtagggccgtatcccacccagagtctgtcaccagattcatgcctgccccaccccaggctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggtgggtgtgggggctgggctgtgggggatccttggggatgtgggggcctgtttggctggcatgatggtccttatcctcctccctcttcccaagcaggagtggccctcgcttgggcgatagagaggtttctctctcatttggtgtcctctttggtagtggagacctggtcccaggtcctcacacctcttctcatcttcctgcagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggtacctggtttcctcactccctatgccccaccctacctgtcctccacctgccttgggctctatactgctgccttcttcttctttttttcttttcttttttgaggcagagtttcactcttgtcgcccaggctggagtgcagtggcataatctcggctcactggaagctccacctgggttcaagtgattttcctgcctcagcttcctcagtagctgggattacaggcacccgccaccacgcccggctaatttttgtatttttagtagagacagggtttcaccatgttggccagtctgatctcaaactcccgaccccaggtgatccacctgcctcggcctcccaaagtgctgggattacaggcatgagccactgttcccggcctgtaccgagttctaaagggaaaacaaaccagggcagtgggaggggtggggagagacacttgctggctctcaccaagggtggaattgactcactgtacctccactcacctccagccacccccatcctccacacatgccccaaacacacctgcctcttttctgagaactgttggcccatctcaccttcccaggctccagagcctaccagaagtgcccagccagtctggcattaaatgacatgtgccaaggttaagcagttcattcacccggtgccagacactggtgggcagtgccaaagcagcagtgacaagcccaggccccaggctgtgcctgttctaggagaagccatcacaggcctgaacctacagccaggctcttgtccccgttggcctcaggcctgggcctgagcaggtgggtgtcccaccttcattcctttacctgttcttccacctttaccttctggccatttaatggttttgggttttttgtttgtttgtttgtttgtttttaatagagacggggtttcaccgtgttagccaggatggtcttgatctcctgacctcatgatccgcccgcctcggcctcccaaagtgctgggattacaggcatgagccaccgtgtccagccccatttaatggttttcttactgactttactaaccagtgctgcttgatcctgaaagcataatagcagaacatggggaacttttagagacattcatgtccacttaggtgcagacagtttgggggaagaagtgtgtgtgtagagagaaaatgaagaatgattaagacaataacccttaaggaatccaagtgaaaagtatatagggattcttgtacctttttttttttttttttttttttgagatggagtctcactctgttgcccaggctggagtacagtggcataatctcggctaactggaagctctgcctcccaggttcacgcaattctcctgcctcagcctcccgagtagctgggactacaggcgcccaccaccacacccggctaactttttgtgtttttagtagagatggggtttcaccgtgttagccagggtggtctcgatctcctgacgtcatgatccacctgccttggcctcccaaagtgctgggattacaggcgtgagccaccgcgcctggcctttttttttttttttttttctggatctccccctgttgcctagacgagagtgcagtggggtgatcatagctcactgcagcctcaacctcctgggctcaaacgatccttccacctcattctcccaaaatgctgggattgcaggtgtgagccaccaagccctgcctaagctttcattttaaatatgttcagccgggcacagtggctcacgcctgtaatcccagcactttgggaggccaaggtaggcagatcacttgaggtcaggagtttgagaccaggctggccaacatggcgaaaacccatctctactaaacatacaacaattagccaggcgtggtggcatgcgcctgtaatcccagctacttgggaggctgaggcatgagaattacttgaacctgggaggcggagattgcagtgagctgagattgcgccactgcgctccagcctgggtgacagagcaagactctgtctcaaaaaaaaaaaaaaaaattagctgggggtggtgacacacctgtaatcccagccactcaggaggctgagacagaaggatcacatgagcctgggagattgagactgttgtgagccatggttgtaccactgcagtccagcctggatgacataggaagaccccatctccaaaaataaaaaaaagccagctcttcctttgagccccagtttcagttcaaagggccttctctaacttctccttcatctgaactcctgagacagggtcttgctctgctgcccaggctgaagtgcagtggtgcagtcatagctcactgaagccttaacctcctgggctcaagtgatcctcccacctcagcctcccgagtagctgggactacaggtgtgcgccgccaccatgcctggctacactttttttttttttttttttttttagagatgggatcttgctatgttgcccaggctggttcttgaatgtctgaggtcaagcaatcctcctacctcagtctcccaaagttctgggatgacaggtgtgagccactgtgcccggcctccaccccagtcttatttcaggacatacagagatggatgttgtggacccgcctccagagcatcaggcttggccctggggtcacagcactgatggttctgtgtctccaccttcttccccactaggacatcacacccctgcaggtggttctgcccaacactgccctccatctaaaggcgctgcttgattttgaggataaagatggagacaaggtggtggcaggagatgagtggcttttcgagggacctggtaagttctgtctccatagggctccctgccttcctgtcatagccctgataccttctgaccatcaccttccctccccaggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaaggttgaggaaagcctcctgtagccccagagaggcgctttcctggtatcttttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagatgttcaaatacaattgacaaatgtaggccaataggtacagtggctcacacctgtcatcccagcactttgccaaggtgggtgaatcgtctgagcccaggagcttaagaccagcctgagcaacacagtgagaccccatctctacagagaatttaaaaattagcctggccttggacacacacctgtggtcccagctactcagaaggctgaagggggagaatttcttgagcccaggatgtggaggctgcagtgagctgtgactgcaccactgcactccatcctgggccacagaggtactaccccgaggtgctaccattcccactttttttttttttttgagacggagtcttgctttcttgctgttgcccaggttggagtgcagtggcgcgatctcggctcactgcaagctccgcctcctgggttcacaccattctcctgcctcagcctcctgagtagctgggactacaggcgcccaccaccatgcccagctaattttttttttttttgtattttttttttttttttttttagtagagacagggtttcaccatgttagccagggtggtcttgatctcctgacctcgtgatccaccaggttcggcctcccaaagtgctgggattacaggcgtgaaccaccgcacccggccattcccactttctatatatcaaaactgggatgcagaatgcaggttgcttgccctggggtgtggccaggcagggcgaggctgggacctgcatccaggcactctggcttctccagtaaaccaaaggacatccacaactctaacagaggcagttctgctgcctgttttagcagaaggacaaaagttggtctttggagcttagagaaggcagaacaggctgttggcatagcagcaacttgggcatcttaggaggccaaggtgggcggatcacttgaggccaggagttccagactagcttgggcaacatggtgaaacaccatctctacaaaaaatacaaatattagccgggcgtggtggcacgtgcctgtaatcccagctactcaggaggctgaggcatgagaatcacttgaatccaggaggctgaggttgcagtgagctgagatcacagcctgggcaacagagggagactccgtctcaaaaaaaaaaaaaaaaaaaaaaaaacttttaaaattcaactggggtgggggtttggcctcaaaagaatgaataagaggaccgcagtcaggaacttgagcctggggtcagtgctatctttttgcctatgaaatctgtcaatcccctgtgtctaagctgtgggggaggggtaggtggggagcaggctggggggcccttgtcccttaccctccactcttggcccaggggaagaatggctggtcaccacagtaggggcgtacctcccagcggtgtttgaggaggttctggatttggtggacgccgtcatccttacggaaaaggttggtgctctgggggctgtggtttaagggacctggggctagggaaccctccgagtggcagagaatggtggtagaatggcatgagagtaaaagagaagcaataattttagggtcacttaaaaaaattcagagatcagattgcctgagtattctggatcatctgaagggttaaatagtctttctggggctgggcgcaatgactcacatctgtaatctcagcaatttggaaggctgaggcaggaggatcacttgaggccaggagtctgagaccagcctgggcaacacagtgagaactcatcgctacaaaaaatttaaaaattagctgggtgtagtggagcatgcctgtaattccagttactccagaggcgctgaggcaggagaatcgcttgaaccccagaggcagaggttacagtgagccatgatcatgccactgtgctccagcctgggcaacagagcgaaaccctgtctcaaaaaaaaaaaaaaaaaacaaagccggtcgggtgcagtggctcatgcctgtaatcctagcattttgggaggctgaggtgggaggatcacctgaggtcaggagttcaagacaaacctggccaacatggcgaaaccccatctctactaaaaatacaaaaattagctgggcatggtgtcacccacctgtaatcccagctgtactcaggaggctgaggcaggagaatcgcttgaacctaggaggcggaagttgcagtgagctgagatcgcacctttgcactctagcctgggcaacaagagagagactccgatttaaaaaaaaaaaaaaacaatccctggattggtagaaattgtctctgagatctgggagcattgggagcatttggtggccaatggggctcgcagatcccctgaagttggaggcaggtcactcaaatacccaacatgttgctctgcagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaaggtgaggtccctacacccccacagaggactgccctgggagatgtatgtcctctagtggcatgaggccctctgccttctctcctccagacgcacgttctaggaacaccttctgtgcctttgcatgcttagttcttacacacctgagacactggcccatttgattcctggcagcctctgacttacccctcagacctgaagttaattccccttctgggaaggcctcctggctacccgctgcctgagactctgaaactctgatacagtcatgcgccacttaatgatggggatacattctgagaaatagtccttagatgattttgtctttgtgcaaaagagtgcacttatgcaaacctagatggcacctagtctagatggcgtagcctgcccctaggctgccaacctgtgcagcatgtgactgtcctgaatactgcaggcagctgaacacaatggcaagtacttgtgtatctagccatagaaaaggtaaggtaaaaatacaatataaaagcttcgttataggccagcacagtggctcatacgtgtaatcccagcactttgggaggccgaggcaggtggatcacttgaggtcaggagttcgagactagcctggccaacgtggggaaaccctgtctctactaaaaatacaaaaattagccaggtgtggtggcacacacctgtaattccagttactcgggaggctgaggcacgagaatcacttgaaccctggagatcaagcctgtggtgagccgagatcgtgccactgcactctagcctgggcgatagagtgagactctcagaaaaaaaaaaaatctccattataatcttacgggaccaccatgtgcagtctgtaatggactgaactatcatgcagtgactatatttcacatctttaatatcctggtgttcactttgctttgtcatcttttgtaaaataaacctcttggtttaccctctcccaccccctacttcatcccctctctgaactatatgtgggaataccagcagttgccaaactcattctgtaaagggggctggatggtagatactccaggctccgtgagtcattgtttctgtggaagttcttcaactctgctgttatgtcaggaaagcagcttgggcactacgtaaacaagtgagtactgccatgctcctggaatagtttatctgcaaaaacaggaggcagaaaaagtagaaataggccaggcatggtggcttacatgtgtaatcccagcactttacgagtccaaagcgggtggatcgcttgaggtcaggagttagaaaccatcctggccaacatggcaaaaccctttctctactaaaaatacaaaaaaattagctgggcatggtgtcaggcacctgtaatcccagcttctctggaggctgaggcaggagaattgcttgaacccgggaggcggaggttgcagtgagccgagatcacaccactgcactccagcctgggtgacagagcaagactgtctcaaaaaaaaaaaaaaattagaaataacccaaatgtacatatataatgaatggataaaaaattgtagcatatccatacaatggaatatcattcagccataagaaagaaatggcaggccaggcgcaacagctcatgactataatcccagtgctttgggaggccgaggcaggaggattgcttgaagccaggagtttgagaccagcctgggtaacatagtgagaccccatttttacaaaaacttttaaaaattgaccaggcatggtggcacacctgtagtcccagctatttgggaggctaaagtgggaaaatcgcttgaccccaggaagtggagtgtatagtgagctatgattgtgccactgtactccagcctgaggcagtagagtgagatcctgtctctaggaaaaacaaaaaataatgacatacgtgctacaacatggataaaattgaaaatgttatgctaagtgaaagaagccagctggacgcagtggctcacgcctgtaatcctaacactttaggaggctgaggtgggcacatcacctgaggtcaggagttcaagaccagcctggccaacatggtgaagccccgtctctgttaaaatacaaaaattagctagcatgatggcgggtgcctgtaatcccagctactgctcgggaggctgagacaggagaatctcttgaacctggaagacagtagttgcagtgagccgagatcccaccactgcactccagcctgggctgctgagccgagactccatctcaaaaaaagaaaaagaaaaaagccagacatcaaagaccacatattgcatgattccatttatgtgaaatgtccagaataggtaaacacataaagaaaatagactagtggtgggtggggtaggtggggagtggcagtaacttctaggtacaggatttcttttcagggtgatgacgaaaatactctagacttaacatagcagtgatggttggacaactttgagtatactaaaacaactgaattgtgaattgtatactctagatgggaaaatttcatatgtggattatatctcaaaatttttttaagaaacaggcggtgctgggcgtggtggctcacatctataatcccagcactttggaaagctgaggtgggtagatcgcttgagtctaggactttgagaccagcttaggcagcatggcaacaccccatcatctacgaagcacacaaaaattagctgggtgtggtgatgcgcatctgtagtcccagctccttgggaggctgaggtgggaggattgcttgagcctggaaggttgaggctgcagagagctgagatcatgccactgcactatccagcctgggcaagagaggaagactatctcaaaaaaaaaaaaaaaaaaaaaaaaaggcagaatccagatttggcctgaaaaccagagtttgtcaagccctaggttacaccatctctagaaaacaaagcctgggagaaagaagaaaaaacaggttgatttttaatggtttagcttgcgtggatccaggtcctgacagttatggaatctttcaaggacacatttgaccagatgagatttggcaggcgtttgtgtagagcctcacagtccagacagtgcctcaccgtattatgatgtgggggtgggggcgggcttctggtgctcttgtcctccacacaggcctgaaacagcacaggactggggaggtaccattggaagcacccgcaaccctaaaggcactgaccctaacctcacgtctccccactagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtaatggctgggagtgagcagcagtgctgccacgtggccttggccttggtggcggcttcctctgggtgtgtggaagaggtgggcagggacttcagcagcatggagagccatatcaggtgggctgtctggttgggggagggcactacgtggagtgtttgccatccttctgccttaaatgtctcatttgaaatgttagaaccaaccaggtgcggtagctcacatctgtaatctcagcactttgggaggccgaggcgggcggatcacctgaggtcaggagttcaagactagcctggccaacatgggaaaccctgtctctactaaaagtacaaacattagtcaggcgtggtggtggtctgagtagtcccagatacttgggaggctgagacaggagaattgcttgaactgggaagcggaggttgcagtgagccgagatcacaccactgcacttcagccagggtgacagagtgagactctgtcaaaaaaaaatattagcatgtccactgagaggacaagtgggggtttaggacagggaccctttcccacagcagacctggtttccagcataaaggtctgatggggtggccagggaacaggaaggacctcctccctcatgcccatatcccggtggaatctttcatttttttctgcttcacctaaaaccttgaccttgatttgacctcgggccacatctccaaccttctctaagaatccaagctggaagtccagcttggaatccgagggagcatccgtgtacacagcctacttcaccatccccgaggtgccctccaaactgccccatgaaggaagattctagaaataacattgagcaccttctctatgccaagagctgtttgagctagacatgtgaagatgtcattcacccctagaccctgcaaggtagccaccgtcaagtccacttgacacatgaggaaactgaagcccaaggggtgaggtagttagcccacgatgacagggccagcagatggcaaacccggggtggagcctggcctccccgtagagaaggtgtttaacctcgtggcgcgccttccctggatgggctctgctttgggacagctgggcggatcttcctcccttccacccttacgggcagcttccctccctgtcctcgtcccaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccggtgagtgctggcagcgcagggtgtagggggtggctctccatgggtctggctctgaccctcggctgtctctgcagcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggtaaaaatggggacagggcatgggggtgcattcctggaatcccagcactttgggaggctgaggtgggaggatcacttgagcctaggaggtccaggctgcagtgagccttgatggccccactatactccagcctgggtgacagagcaagaccctgtttctttgttttttgtttttttagttttttggttttttggttttttggttttttttgagaccgagtttcactcttgttgcccaggctggagtgcaatggcgcgatcttggctcactgcaacccccacctcccggattcaagcgagtctcctgcctcaacctcccaagtggctaggattacaggcatgtgccaccatgcccagctagttttgtatttttagtagagatggggtttctccatgttggtcaggctggtctcgaactcctgacctcaggtgatccgcctgcctcggcttcccaaagtgctgggattacaggcatgagccactgcacccggtcaaccctgtttcaaaacaaaaaaaacaaaccgggtggcaagcagtgggtgagggttcctgctgggtgcagcctaggaaccccaagaaaaggagggtcctgctcaagtgctggtgctgggctcctcatgaaggcaggacacctcattcagtgctgaggtcaagagggaacctaggagttcacgcaaatccagggaaggcgtgggctcacctcctggggtcaggactcagggatccagtagcaggacactaccccaactaagctcccagtgagcgtgcagccaaatgcgtaactgtcgggctgttaaaagatgcatgggacacagctggcgggagtgggcagtgcaagggggcggtgagaactcaagttcagaaactgactgccctggcctgcgcccccgccctgctgtttgcagcctgtggacctggggaagggacagggtgctttcctcagtttccccatctgtaacatgaggaagacagcattttctccttcacaaggccattgaaaagatgcaatgagtgttagaacagtgcctctattggtcagagctcaatagcagctattaggattgggtgagataagtcatgtacagaaacagtgttcatgactgggtactgtggctcacacctgtgatcccagcactttgggaggctgtggcaggaggattgcttgaggccaggagtttgagaccaggctgggcaacataacaagactctgtttcaaaaaaaaaaaatttataaactagctgggcatggtggtacatgtctatagacccaactacttggaaggctgaggtgggaaaattgcctgagcccaggaatttgaggctgcagcaagctatgattgtgccaccacactccagcctggacaacagagacccacagagaccctgtctcggaggaagggaggaagggaggaagggaggaagggaggaagggaggaagggagggagggagggagggagggagggagggaggaagggaggaagggagggagggagggtcaggcgtggtggctcatgcctgtaatcacagcactttgggagactgaggcaggcagatcacttgaggtcaggagtttgagaccagcctggccaacatggtgaatccctgtctctactaaaaatacaaaaattagccaggcctggttgtgggcacctgtagtcccagcttgtagtcccagctactcaagaggctgaggcaggagaatctcttgaatccgggaggcggaggttgcagtgaacccagatcgagccactgcactccagcctgggcgacggagcaagactgtctccaaaaagaatattcaatactcccaagcatgtccctcacctcttagctgagagcagccagtgccctgatggcggcagacagctgccgacatattcccagggctgccgacatattcccaggcactacaacatcatagttaagagcacaggccccagaagcagctgcctggttcagctttctggcttgtcacatgttatatggcaagtcttgggccagccacttgacttccctggacctctacttcctcatctgtaaaatgggggtggtgatcattgccatctcatagggtggctgagtgggattaaaggagaacgtgtgttaagtttttaggaccttaccaggcatacattagcattctctattgcgagagaccctgcccggccacacaggatgggtgttgaagttcttctcggagagagttgctggctgggcgtgatcacacatgtagtcccagcactttgggaggctgaggttggggggttgcctgagcccaggagttcaagaccagcctgggcaacatggcaagaccttgtctcttctaaagagagattcctgggtgaaagcagcttccccattctgggcctgtttgttcacaggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagtaagtgaggctgggagctcggctgcctataatgcccatggcaggccactgctgggaactggataacctggcatcccttgtggactgcctgctgccatccctaccctcaaagatctattccctacccaacagatcaggtgacccacttaaaatgtgaatcaggctgggcgcggtggctcatgcccgtaatcccagcactgtgagaggctgaggcaggaagatcacttgaagccaggagtttgaggctgcagtgagccatgattgcgccactgcactccagcctgggcaacaggcctgggagactgaccctgtctcaaaagaaaaaaaaaaaaaaaagcacgtatcagatgtggctcctgcagcctcccatcttgcatgtgataaaacctaaactccttcctgcagctccagccggcctcccccgatttgccttctagcctcccccttccatgctcctcgtccctggaacatgttccagctgacatgttccagccccactggcttcctctgctccttcaatgcacagcttggacccacctgaaggccttttgcaatggctattcctgctgcccagaaagcttccccccgcccctgagctcccttccaggcaggcttctccttctggcttcagcccaaagatcccctccttggggaacacttttctttctctcacagctgaatagcaccctctttgcctggtctctcccacacttgtcactgtctgaaatcctccttgtatacttgttcttttcccactcaagtggcgtgaaagtagggggccgcagtcacgcctgcatttgtccggcctagaatgacactggcttgtggcgcgtataccattctgggttgagttgcgtattgggtgccttctaggggctggggtctgtcctgggcaccggtttggttggtggccgctgcccttggcgctcctgttcctgctctggccccatgccagcctctcacctgcgctccgtctcctccaggcatgaggctcagagactggagcaggaagcccgcggccggcttgagcggcagaagatcctggaccagtcagaagccgagaaagctcgcaaggaacttttggagctggaggctctgaggtgggttgagaactagaggaggagactggcaggggccgagggtcttaggacagcagctggtgtgggcagcaggcctgggtggggtgtcgatgagacagtgcacggctacagcataagccaaggccgtggggggactgggctgtctcccgggtcttacctgactctgccttctccccagcatggccgtggagagcaccgggactgccaaggcggaggccgagtcccgtgcggaggcagcccggattgagggagaagggtccgtgctgcaggccaagctaaaagcacaggccttggccattgaaacggtgagtggggggaggcattaagaagagggtggccttgagtcctggaaaaggcccattccctacagtccctgagactgtataggacaccaggtcccccaacataaagccctatccaagtactttgcatttgcaaagtcctttgccttgtaggattcattgactccattgctggaaggtaaggattagaacacccattttgcagctgggcgctcatgcactggccaccttggcacaagtgctgtgtatgcttcataggcattatcttatttaatgcttgaaatcccattaagaggccgggtgcagtggctcacgcctgtaatcctagcactttgggaggccgaggcgggtggatcacctgaggtcaggagttcaagaccagcttggccaacatggtgaaaccccatctctactgaaaatacaaaaaattagctgggtatggtggcatgtgtctgtaaccccaactacttggtaggctgaggcaggagaattgcttgaacccaggaggtgtggaggctgcggtgagctgaggttgtgccactacactccagcctgggcaacaagagtgaaactccatctcaaaaataaagtaaataaaaataaatgtaaaaagaggcctagtgtggtgcctcaggtctctaaccccagcactttggaaagctgagatgggaggatcatttgaggtcagttcgagaccagttcaagactagcctgggcaacatagcaagacctcatctctacaaaaacaaaattttttaattgactgggtgtggtggcacatgcctgtagtcccagctacccaggaggctgaggcaggaggatcctttgagccaggagttcaaggctgcagtgagtcctgatctgcattccagcctgggtcaaaaaataaagaatgattgatttttcctcttccaggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtgagagttggggaaggtgtgttggtttcaggaccaaccttgaaaccaggaaggcagagccaaggcggaaaacacaacatctggaaagattgtggggaagggaggggtgagtgacctgacccacgatgcagggacattcacacagtgtcacgctgcatcaacgtcaggcactgtactagacccagcagtgagccagagctccggaggagacaggaaatggatgggacgccagtctgacaggcatttccaaggcagtcaagcagggtggtcagatgcaggggaggtgacccttcaaaccagctgacttaaggagggtcactctgaagtggccagggtttgacgcccatctcaacttcctcctgttctcaccctccaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaacacttttctcttgtctgacattggttggggttaccagggagcttaatggtggggaggggaggtgcccctggcatcttttttttttttttcgagctggagtcttgctctgtcacccaggctggagtgcagtggtgtgatctctgctcactgtaacctccacctcccaggttcaagtgattctcctgcctcagcctcctgagtagctgggattacaggcacgtgccaccacgcccagctaatttttgtattttttagtagagatggggtttcaccatgttggccaggctggtctcgaactcccaacctcaggtgatctacctgcctcggcctcccaaagtgctgggattacaggtgtgagccactgtgcccggtcaacatctttagatagttacaggagactcttctcctccataaaggggagaggaccccgaggcaggggaaggatgagctggaagtcacccagtaggaatgtggccccaaagccttgtgcactgggcttcctagagcccagataggggtgatgatgccacgggtgggggcatggggcccacaatggcaacatctcaccactggttctccaggagcccagctgcctggtagctctcagctgttgcagatgcaacccagcttcccattcgggaggcgccctccagcgccacctgctggagcacccacagcaccagcagacgtgtcaggcttgcacccggtgctgtgcgcttgtcccttcccaggtgggggtgtcaggttggggaggaggaccctgcctagggcagtaggaattgggcatctccttgagcttccggtctgggctgtttgggagcactgaaggaggagtgcccttatcccaccttctcccccacaaccagtatggggtcctcatttgagagaaggatccaggtgcagtcagcctgggtgcactagccctttggggccaggaacagttgtaggtgccaggcctgccccgtctctgccgaggaagtaaaaagatcccaggggccgagtgcaagagcttaggcctgtaaccccagcaccttgggaggccaaggcacaaggatcacttgagactaggagttcgagaccagcctgggcaacatagcaagacccccatctctaccaaaaaaaaaaaaaaaaaagcaaaagccagatgttatggcatgcatccgtgttcccagctactcggggggctaaggtgagaggattgcctaagcccagaagttggaggcagcagtgagctatgatcataccactgcagtccagcctgggtgacagagggagaccctgtctctataaaaaaaaacaaaacaaacaaaacccttaaagcctccctaaagccctcattttcaccttcctgtaatattgagtggaaaaagcccgatccccccttaaaccacctccctccctctctgccctgcccctgaccgttgctgcaggaggaacaccccacggagctgactgatcttattttaaactcatgggaacaaattttgagggaggtgcagcttctctggctgtgctgctctgtcttgtgtgcgatccgctttgagacaaccattcacaccacctctcctctcagcctcctacacccctgcccactttctctcacctctttgagaaaatagaagcaaattgggtaggaaggcccttcccagcaacaaacctaacaaactgctggcatctagactgtcctccctcctcttcccaccctgggctcctccccttgggctctaggagagagggctgcattccttcactgattgccgtcctctcctgtgctgtcaatttttttttcttttttttttttttcttgagactgagtctcgctctgtcacccaggttggagtgcagtggcgtgatctcagctcactgcaacctctgcctcctggattcaagtgattctcctgcctcagcctcccgagttgctgggactacagtcatgcaccaccatgccctgctaatttttgtatttttggtagacatggggttttgccatcttgtccagactgatcatgaacccctgacctcatgatctgcctgccttggccccccaaagggctgggataacaggtgtgagccactgtacccagctgatatgccatcaatttcttctctcctgcatcatcatcatcaggatatagacatgtctactctgtccatataaaacaactcccttaaccctatgagcccctctaacttccacctctcctttttccatcacagccaaatttttccagagttctctgtggtctcactttccattcctcatctctcattatctcttcaaaccactccagatagggccaaacgtggtggctcacgcctgtaatcccagcactttgggaggccgaggtgggtagatcacctgaggtcgggagttcaagaccagcctggccgacatggtgaaaccctgtctctactaaaaatacaaaagtgagccaggtgtggtggtgggtgcctgtaatcccagctactcggcaggctgacggaggagaatcgcttgaacctgggaggcagaggttgtagtgagcgagattgcgccattgtactccagcctgggcaacaaaagcaaaactccgactcaaaaaaacaccccagtttgcttctgtctctgccccttactttatggaaactgctttattcggcatcaccagtaatgtcccgttgctaaatccagtagttgatcggtcacttggcacagttggccattcctcccatgctgggctttcctgacatcacctgttctagttttctttctcgcttctctcagtaggttccctaaggcccacttctcatgctgacattcttgtccaatcgcatgacctcagatggtctctataccactgacctcagaatccattactccagctccgacctcacccaagagctctggactcatttccaatccatgccttgatgtctccacgtggacctcaattggtgatcaggctttggctcttgccaatgaaatgcaaggggaaatgacatcacatgcctgttcttcccttttccatataaatgggtgaccagcaatgttccaagtggaagctgctccaaccacctgggtcccagggagaaaatggcatgaggtgcagccacagctgacctgcaacagacatgtggcaggagtgagaaatgtttgctgtattaagcaacggagatttggggggttttgttaccacagtataacctagcctatcctgactactttgtgtgcctcacaggattgtaagatctcataggtcataggggaaactcctctaaattgtatgcaaggggccaggtgcagtggctcacgcctgttatcccagcactttgggaggccgaggtgggtggatcacctgaggttgggagttcaagaccagcctggccaacatggtgaaaccccgtctctactaaaaatacaaaaaaaaaaaaaaaaacacaaaaaaaactaggcgtggtggcacacgtctgtaattccagctactcaggaggctgaggcaggagaatcgtttgaaccccggaggtggaggctgcagtctgccgagatcgtgctactgcactccagcctgggagagggcaaaactccatcttaaaaaaaaaaaaaaaaaattatatgcacgaagaggggcccagcacaggccatagagtggggaagacaggacttgctggaaatacagtgagcttctgtctccaaaaaaaaaaaaaaaaaaaaaaattagattaatttttttttaactttacatttttaaaattttaattattaggtttaacctcaaatttttttttttttttttttttgagacagggtcttgctctggcttggtggttaaatattttgaatttcatccctggggcttagggttgccccaagcaacctgtttactgaaagaagcctgaaatatacattgaatttttttttctttttagacagagtctcgctttgtcgcccaggctggagtgcagtggcatgatctcggctcactgcaacctctgcttcccaggttcgagcaattctcctacctcagcctcctgagtagcgagaattacaggcgtgtgccaccacgcctggctaatttttgtattttttgagacagagttttgctactgttgcccaggctggagtgcaatggcacaatcccggctcactgcaacctctgcttcctgggttcaagcgattctcctgcctcagcctcccaggtagctgggattacaggtgcctgccgccacacccaggtaatttttgtatttttagtagagatgaggtttcaccatgttggccaggctggtcttgaactcctgacctcaggtgatctgcccgccttggcctcccaaagtgctggggttacaggcatgagccacagcgcctggccctagttttttatatcttaaaaattaggcctatgtctaatccaaaaaaagtgtttttagattaaattagctaggtgtggtggcatgtgcctgtagtcccagctactcaggaggctgaagtaggaggatcacttgagctcaggaatttgaggctgcagtgagctatgacggcatcactgtactccagcctgggcaacagagtgagaccctgtctcaaaaacatacatagagaacagtgtgatctctgaagaagttcaacacagcctgtttttctctagcactagaacaaatggcttttctttggttgaataccaaagtaattgatgtgttgaaggaccccctttataagaaaaatctgtgtctttcaacagcgaacacattcagcatggtaagatgctgtttaccgaatcagtttcctcttccacttacgcccacaactaatctgtgtcccagcttcccttgtcctcagacactgccgtgtgaccgagttgtagccaatggaatggaagtggaagtaataagtgctaatttcctgtctttccataaaaacttggctcctgcaacctccatacacatcatctgcctacatgatgcaaacaagctgggcagtcccaggagccacgtgttgaaaatggcagaatcacagaacaggagatgcccgaattcctgaatcgccgcttgcaggagagctgtctcccagtcggcagcatctgattaagatttaatatgagttagaaataaaataatgttctttcttttttttttttttttttgagacagagtcttgctctgcctccaggctggagtgcagtggcacggtctcggctcactgcaacttccgcctcctggttcaagtgattctcctgcctcagcctcccgagtagctgggactacaggcgtgcaccaccacacccagttaatttttgtattttttgtagaaatgaggtttcaccatgttggccaggctggtctcgaactcctgacctcaggtgatcccccacctcagcctcccaaaatgctgggattataggtgtgagccaccacgcctggccaactctttaactcttttgtagcaatggggacttgctatgttacccaggctagtctcaagctcctgacctcaagtaatcctcctgtttcagcctcccaaagtgctgggattacaggcatgtgccaccacaaccagtctagaaataaactatcatgtttgaggcactacacatcttgaagtttgttacagtagttagggttatttttaatcacagaaggagagccttgaagactgagactgcctagaggaacagcaaatgtacaggtactgatctcctgccctccgaggcgcagtcattgagtggaacaaacaaatgaaacttcttacacagtggcgtggtgatcattcatttattctgaaggcatatagctgattccagaaggctattactgcacatataacgtgactccactatgttccctagatcaaatatagatactccagggcccaggtcagctcagcctttccccactccccacctccagatcaagggctctgcaggttcttcctgagcccaggccagccactggacatggaacgccggcaccagtctgactgcgagccacgtccctgtaggccaaggggacttagaagccctcctgtgagtcttcagtgctaccctacaagcctcaggatgctcgggtgcagattcttttagactgcccgtgctcacactctcctcctcaactctcttttttaagatcacatatggccaggtgcaatggctcacgcctacaatcccaccactttaggaggccgaggcgggtggattacctgaagtcaggagttcgagaccagcctggccaacatggagaaaccccatctctactaaaaatactaaattagccgggcgcggtggcgggtgcctgtaatcccagctactcaggaggctgaggaaggagaattgcttgaaccccaggggcagagattgtagtgagccgagattgcaccactttactccagcctgggctaaagagtgaaacttctgtctcaaaaaaaaaaaaaaaatcacatatggccaggcatggtggttcatgcctgtaattgcagcactttgggaggttgaggtgggaggatcacttgagcccaggaattcaagaccaacctgggcaacataaggataccccatctctacaaaaaaatacaaaaatagtgtgctgggggtggtggtgccgcctgtagtcccagctactcaagaggctgaggctggaggatcacttgagcccaggaggcagatgttgtgatgagtcgagatggagctactgcactgcaacctgggtgacagagtgagaccttgtctcaaaacaaaacaactcaatgtagctggatttacacagtcagccttctgatgtcactgtaaatggttagagccaaggagcctaggagccagccagggacatgggagtcaggcaggccaagggctctgtcctctggggctggagagagaggacccaccaggctggaggaagagccaacaggaaggagaaagggctgcagggcaggcacagggacagcccctgacccagtctcctaccttgactgcagcaggccaggtagtggggtgcccacagctggaaacgcacctcagttttttgttttttgttcttttgagacggagactcatctgtcgccaggctggagtgcagtagcacaatcttggttcactgcaacctctgcctcccaggttcaggcgattttcctgtctcagcctcccgagtagctggaactacagtaggcgcgtgccaccacacccaggtaatttttagtagagacagggtttcaccgtgttagccagggtggtctctatctcctgacctcgtgatctgcccaccttggcctcccaaagtgctgggattacaggcgtgagccaccacacccaccgcacctcagttttgtgcaccaatagcttcttcaagcacaggtctgtccctgccactgtcctgctttaagcccctcaacgttcatcctatacgtgtcccccaaaaagcgcgagatgatttaccgcagcaccattcacagtggtaggaccaggttaaactgaatttttttttgagacagagtctcactctgtcacctaggctggagtgcagtggtgcgatctcagctcactgcaacctctgcctcccgggttcaagcgatcctcctgcctcagcctcccgagtagctgggattacaggcgcctgccaccacgcctggcgttctatgcaaccattcagaagcccgctggcgtgaaagtactgcgtacaattaagtgttcaggtacaggctctggaaccagactggccaggctgccacctctcggggcctgtttcctctctggggaatgagaacagtaacagggctgtcgtattgtgtgcaactgtacaattgtgagataagataatgcacgcaaatagcacttagagcagggtagcttgtgttagcagaacagcacatacataaaatgaatgttaagatatggaaatgggctagacacagtggctcacacctgtaattctagcgctttgagaagccaaagcaggaggatcacttgaggccaggagtttgagaccaacctgtgcaacacagtgatacccccatctctacagaaaaacataaaaattagccgggcatggtggtgcatgcctgtagtcccagctgttcagcaggctgaggcaggaggactgcttgagcctgagaggtcgaggctgcagtgagctatgatcatgccactgcactccagcccaggtgacagagagagaccctgtctccacagtaaaattttaaaaagtcctctgggctcctaggccgccccagctggcttctgcgtcgcctctcaccagctctcccagcccccaacccccactcccccaacctccctggagcacttggtgctccaggccctgtgacctagatctgtttcttttttttttccccaccttgactggagcaggccaggttggcagggatggtaggggtgcctgatgcgcttgaaacacacctgctttgtgcacaattttttttttttttttttagacggagtctcgctctgtcactgggctagagtacagtggcatgatcttggcttactgcaacctccacctcctgggttcaagcaattctcccacctcagcttcctgcgtagctgggactacaggcgtgcaccaccacacctggctaatttttgtattttttgtagagatggggtttcaccatgttggccaggctagtctttaactcctgacctcaaatgatccacccccttgggtggatcccagagttctgggattacaggtgtgagccactgtgcccggcctagatctgttccaatttctgttgtcactgtaaatggttagaaccaaggagcccaggagccagtcagggatgtgggacccaggccgaccaagggctccgtgctctggggctggagagtgctcagaggacccaccatgccggaagaagagctgacaggaaggagaaagaggtgcagagcccaggggcctctctggcctccctgccttcccatgccattccctcagctaagaaccaatctcctctgcactaaccctttcctctccaatccctaccagccttctacatgggatacccagccccttcaccaaaccctaaatcaggtcctaggtgtcttctactcccacccccaacgagcactttcctatgttattgtagaggaagccagctgcccagtacccagtgaatcccctgggcctagcacaggagttgaggctcagtacatgtctggtaaatttctgctctcctggacacgggggcctcttgggccacttggctaagctatcatgcagatagaatgagtaacatctgcaaagaacccgcagcacagagtctggcatgcggtacagtagtttaaaaaccacagatggcaggggatagatgcccagaacagtgcctagtatatgataggagcccataaaaagagggaacagtgtttctcaacattactggaagaattccccggcattcaagttgcaggtttctgagcccatccctagagcttctaactctgaaggttggctgcagggtccaagaagttgcatttattttattttttgagacatcttgttttgtcgtccaggccggagtacagtagcatgatcatgactcactgcagccttgacttcccaggctcattcaatcctttcactgcagcctccccagtagctgggactaaggcacacaccaccacacttggctaatttttgtatttttttttttgtagagacggggtcctgccatgtgacccaggctggtcttgaactcctggactcaagtgatcttcccacctcagcctcccaaagtgctgggattacaggccaggcgtgagcctccaagacgggccaaagttgcttttttttttttttgagactgcctggctctgcctcccaggctggagtggcaccattacggatcactgcaacctctccctcctgcctcccaggctcaagccatcctcccacctcagcctcctgagtagctgggaccacaggcatgtgccaccacatttggctatttttgttattttttgtagagatggggtttcaccatgttggtcaggctggcctcgaactcctgtactaaatccacccaaccttggccttccaaaatgctgggattacaggcatgagccaccacacctggcttgaatttgcattttaaagaaatatccagccaggctttgtggctcatgcctgtaatcccagcactttgagaggctaaggtgggaggatcacttgaggtcaggagtttggggctgcagtgagctatgattgcaccactgcactccagcttggacgacagagtaggactctgtctctaaaaaaaaaaaaaaaaaaaaagaaagaaaagcaaaaaagagaaatagaaatataccacaggtggtctaaggaccacactctgagaaaccaactcattgacagacgagtatttattaagcagctactatatgccaggttcaagttggtcttactctagggatagagaagagaacaagaaaagtctgtgccttcatggagtttacattctagtgagggtagaaaatatcaagaatataaatacatgtagacagtcagtgacatcaaacaagtgggcggtggggacaccacatgagcatgggtggcaggagggcctctctgtgaggtcactgtgggtagacggagaagccagccagcaaactggaggaaaagcacccagacggacgtccttccctaagctccctcaacccaggccctgagccaagaatatctgaaaggaaaccaagtcaaatagtgaagtcccgccaggaccagggtaggcaggacagaggagccggtgacagggaaggctgtggatggcttcttccctcctgggcatggtgccccaagcttgctctggctgggggcggaggtctgactcccgcctttcaggaaacctggccctcacaccacctccctcactcaagcgtccctagcatctcggaccccaggactgagcaggcagggtgtgacactgcccggtcccggcaccccaggagcaccgcctggatggagggggcctcccgcgtatcctccctgatttgaggcccgggtcctcaggatcccagagaacgtgacgtcaccaaagagaggctgacccccatcccagcaggtagaacaacacatgaggaaggcgtgagactgggacctcctagcagggggtggggagctgtgtggcacagcaagactcccagggcaggtgggcagccaggacccggggctccagcgtcacttcttcttggcgcggtctgctgcgtccagggcagccatgttgcgggcggccgtgatcaggtggatgacgctgatgagcgacttcagcaaggcgatgggggcagtgacccagaggcccatccggaacagtcccacagagccaactgcaggaaggcagcaggggagtttggggcccgaaggagggggcctccatctccctgggcaggccagatccccctcccatcctcctgcccagcccctcatctcctacctaaaggtccctcagagaaatggaacaggtagaggaggcagtagaagagctcattcccagcacacaaggtgaacagagcaggctgcacacacagcaaacaggccacgttagcaagaggcaggcgtgtgccaccccctgcccccccagcactaatgaaggcacaatctcggcatattacttctcttatttttttttcttttttacagacagggtctcgctctctcatccaggttggaatgcagtagtatgatcatagcactgcagcctcaaaactcctggtctcagccaggcgtgtggctcatgcctggagtcccagcactttgggaggctgagacaggcggatcacctgaggtcaggagtttgggaccagcctggccaacgtggcgaaacccctctctactaacaatacaaaaattagccgagtgtggtggcacgtgccggtagtcccagccactcaggaggctgaggcacaagaatcgcttgaacccagcaggcagaggttgcagtgagccgataacccgccactgaactccagcctgggtgacagagcaggactctgtctcaaaaaaataaataaataaataaataaacccttggtctcacgcaatccttccaccttagcctcctaagtagagactacaggcgtgtaccactgtgcctggctaagctaattcaagattttgtgtgtgtgtggaaacagagtctcactttgttgcccaggctggtctcaaactcctggcctcaagcaatcctcccacctcagcctcccaaagcgctgggattacaggcatgagccaccatgcccagccattatctttttaaaaatccttccagaggctgcctgtgttcctggaatcaagtccacactccagccctgcagacctctctggcttatctcccttcccgctttcagtcccttctctttgcaggcctcattcccacttgttccctggagtaattcacacaggccttccccaccaatcctcctcctccacgcctcagcttacgggccctcctcctggagtgactgggcaggccctgctctgcgccctcgccttctcctaggctaggaccaggattcagcccagggcttcccacagccaagagcctgaggggtggggtgtgcaggaaatgcttaccctcgaggtgtagtagatccgaagcaccggattcccggacaagtcgatcatcttgtgactctcactgcctcggaccacagaacttggggagaaaacaggggaacccacaaggtttcatgaccactaccatgcatccaatcctcatgttaacacctattgtacagatggaaaactgggcacggctaaggaccagtatcctgccgaaagccacagttacctatttgggggcagagtcaggattcaaatgccacatttgaaagctcccatgccccttcctataagctgtcacctatatggaatcctagaatacccagccagaagagtcctaagaattgcttaatgcaactgtaaacatgactgaagctttaaagagaggcaggtttgcctggggtctttctacaaagcagagctaaaaaggagcccttccaggatgcctagtgccatcccagacacccttccgtctaggctcagcccaccccactgtaatgtctccaagtggcccaggcccccagaatcgcagcagacctgtggaggtgcagccagtgactggccacatccaaactcatgctgatttggaagaacagcgtggctccagggtacagcagggccaggttgaccaacaggcacatggtggagcagcggtccgtcagcatgtccagcatggccccaaaccgggttcctggaagattaggtgggcaagggctgttatggcacagtggatgcaggacaggtgcccatatttggtttatcactctgacgcagggtgtaaacgaagactggaagtgtccgcctgcctggggaggaacgcaggctagaaaacaggctgtgtgtgaggtcagtgggcaaaggtcaccatggcatgaactgagaaaggcatgagagtggagggaacagggtaggaggagaggaaagctatgtctgcaactcatcaaccccagaaccaagactccagggctagatagagacttgatgcctcaggggaagccttacagttgggtctggagaacagattaaaaaattagtcaaccctccagaagccatcacccttccctctccatcctccctctaagcatgccttctggaaccccaactgcttatgcagggcacacagtaggcctccagtaaacacctgttgaatacactgttttttgttttttgtttttttttttccgagacagagtcttgctctgtcgcccaggctggagtgcaatggcgcaatcttggctcactgcaacctccgcctcccgggttcaagcaattctcctgccttagcctcccgagtagctgggattacaggcacgcgtcaccaagcccgctaatttttgtatttttagtagagacagggtttcaccatgttggccaggctggtctcgaactcctgaactcgtgatccacccacctcggcctcccaaagtgctgggattacaggcgtgagccaccgcccctggcctgaatggacttgtattcagagagacctccagcagcgccaccgccatgtcatgtcttgctaatccacacctctcacaagcagtgagttctcaagagctagcttaaattccttttgctacaaaatcagtccattcttgctgggcgcggcactttgggagcaaggcaggaggatcgcttgaggctaggagctggggaccaatctgggcgacactgcaagacccagtctctacaaaaatttaaaaattagccgggtgtggtggcacgctcctgtagtcccagctagtcaggaggctgaggtgggaggattacttgagcccagaagatgggggctgcagtgagccatgatcgcgccactgcactccagcctaagtgacagagcgagaccctgtctcaaaaacaaaaaaacaaaacacaaaacaaaaagccccaggccatcctgttctgctttttccagagatgggaatgacagccctctgactctgaggtcccgaggaggcaggggaagggaggaggggattgttgaaccccaaggctggctgagaggggtgtctgtcaccttgattaagagcgcgagcagcgtgtccatcgaaagcgtccagcaggccgctgagcaggtagaaggaggaggccgtgagggggcagcagggcatgaagtagaaagaaatgatggcgaagacaatccgggcataaccttggaacgggacgcggggagacagggcaggatcagggagcccgccaaggcccctcgccctctcgttcggcccggggccgtgggcagcactcaccgatgaggttgggcacgaacaggaagatattttcgtctggcatcgcggcgcctcccttgctgccccgggcctgctctggagatgccagtgctgtcccagccccgcagcgcggcctcagcctccggcccggcgcatcggccgcaccacctgcgccctggaccccgccgccccaacctggccccagatgctgaagcccgcagccgtcgggagcatggaccggccccgaggtgcgcgggacgcagggggcgcgcgcagtccgcccttcctacccgcaacctccctcgcctctgccagccccgcaggcgctccgggcctccagctgcggtcgccgctgctccagctgcgcgtggcttccgggaacctcctcctccgcgcccgtcgttgcaaaattggagagaggaaaaagtggcttaaaaaaatagttgcggcccctttaaggcctgtcggcttcctttcccttttcctccctccgcccctctcccttggctcgtaccaaagcgcagaggaggagagggaggaaggaaccattaacgtcaagcaaagttagaaacggaaaaggaaagggtaaaagagaagaccgaataaaaatctctgctttccttttgtggagggtatgacttcctggaggcaaagataaggcgataaaattcctcctcctgagtctttgcgtccccaagaggccaggagatttggtgcagtcctcactttactccccgccccctaagtctccagccgcctttgctctcgcaggctctaggcggctagagaggctccagagcgccctgcagatgggttgcttttcgcgtgccccttgtgatgggaggattaggtcgcaggctccaccctacgtcatcctcccaagcttctcaagcgtctggcgcttggggtcactgccctcaaggaggcacctggaggggtacggaggggaggctggaggagcaaacggggcgcgctaggaaattcctctgtctttagttctagaacccctgatctcctagcaacgaggctgcggaacctctgcagactccaagggttttatagcgtccggtagcgacacggagccggctcccccttttccagccttcctccccatctcccattctccatcccccacgacctataccagaggtccttaggcctccacgtctctccttttgccgagtagcccaaggtttccacccatctgccaggtctggggcgtcaagtcggctgcctcggcttgggaaggtgcttgggagggaagaaggaaggagaggcccaccaggcgaaggggtgaggggtagggggttgcgggagttccctctcactcccgaagatataaagcaacctttattattattattattttttcttgtgagagggaatgaggcagcgggatgtttcctctaaaggccttgtttaaacctgggcccggggaatggtggtggactgggttctgggggaaagcgggctggtttctcaggtcaactcaggcttcgactgttcccagggggatggcgtccactccgatggggaatgagggggagaagaagagcagctggccatctcaagctgcaccctccttgagaggaggtccggtgagcactgcagggaaccctagaggtgggaatgtaatgaagtgaaagcctcccaggcagaggcaccccgtgccaggtctgagccacgggccctgagactctagcctcaaccctgagtcctgaagccccgactcatagctctcagcactaggccctgactctaaacccccaccaaacccccctcccccaggtccagagctttctagctaaatctcaaggcccagtccttcaggagcaagctccttggacccacaggccccagcctgggaactcccacagccagcactcccatgtgggagctcccaggctgaacccctccggcttttcctttcccaggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcggtaaccccctgcctcaggaccaccgtgtctagagaaccgctgcccccactatgcctggttacagtccctgacccctcccacccctagctgaactctccaggagtctgtgcccatctcatccatctcacagccagccctaggacctgtgaaatgcccctctcacccgctaacccagtacccactcctcactgctggccgagaatccccttagccccgtctgccctggccgcatctcttctggccacggggatagtcctttctctgactaggtcctctacttccagcattcttcaccaagacctgaggcacagacacctggtgagtgaggcttcaagggagatgctctttgtcctgggagagaggtgaggaacctggaggggagagagtgagggtttcacaatatcccagcagggtgggggaatttttgaaccgtgcacttccattctattctgccctgatcctcaaattctgaattctcagccctctcccctctcttccaccatctcctgctcggacagaaaccgtacctgcagcaaggcatacctcctgccaactcctggtgaaaaggtacatgcagggtccatggctgccaaggctattcgatattaaccaaaccttttgagtttgcactatatgttggtccctgtcttaggagcttgggacactgaaatgaatggtacagtctcagcccttgaagagttcacagttcagtgtggggacagacaaggaaatggccaattataatacagtctggataagtttccataatagaaatggacacagtgggatagtactcttatcccagcttcaattggacaggaaggacaggagccatggagcttcttctttttttttttgagacggagtcttgctctgttgcccaggctggagtgcagtggtgtgatctcagctcactgcaagctccacctcctgggttcacgccattctcctgcctcagcctcccaagtagctgggactacaggcacccgccaccacacccgactaatttttttgtatttttagtagagacggggtttcaccgtgttagccaggatggtcttgatctcctgacctcatgatccgccctccttggcctcccatagtgttgggattacaggctttggagcttcttgaaggaggtagcacctaaagaaataattttccaccaggtgcagtggctcacacctgtaatcccagcatttttgggaggctgaggtgggctgatcacttcagggcaggagtttgagaccagcctggtcaacatggtgacagaggttgcagtgagctgagatcataccactgcactccagcctgggcgacagtgagaccatctcaaaaaaaaaaagaaataattttccaggttaaaaaaaaaagaggttagtaggagtctttcaagcagttggggttgcatgaacaaaggcaaagagcagtcttcgcagagccagtgtgagcatctgtgtgtatttagggcagggagaagcagtttagcagctggagtctacaggcaaggtaagaggggactcaagagactttatgtgccttgtttagagccttacacactttcctggctgggtgtggtcgcttatgcctgtaatcccagcactttgggaagctgaagcaggaggatcgcttgcgtccaggagtttgagaccagcctgggcaacatggtgataccccaggcatgatggcatgtgcctgtgatcccagttacttgggaggtgggaggatcgcttgagcccaggagttcaagaatagcctgggcaacatagagagaccccatctctataaaaagttaaaaaaattagccaggtgtggtggcacgaacctgtggtctcagctacttgagaggcggaggccagaggatcacttgagcctaggaggttgaggctgcagtgaaccatgttcatgccaccgcattccagcctgagtgacagtgcaagaccctgtctcaaaaagaaaaatttaaaaaaaagaaaagaaagaaagaaatagtaggaggagctgggtgcggtggctcatacctgtaatcccagcactttgggaggccaaggcgggtggatcatgaggtcaggagttcaagatcagcctggccaacatagtgaaaccttgtcttaactaaaaatacaaacgttaggtcaggcgcggtggctcacacctgtaatctcagcactttgggaggcccaggcgggcagatcacctgaggtcaggagtttgagaccagcctggccaacatggggaaaccctgtctctactaaaaatacaaaaattagctgggttggtggtatgcacctctaatcccagctactcaggaggctgaggcaggagaatcgcttgaacccaggagttggaggttgcagtgagccgagatcacaccactgcactccagcctgggctgcagagcaagactctttctcaaaaaaaaaaaaaaaaaaaaaagccaggcattgtgtcacgcacctgtaatcccagctacttgagaagctgaggcagagacttgattgaacccgggaggtggaggttgcagtgagctgagattgcaccactgcactccagcctgggccacagatcgagactctgtctccaaaaaattaaataaataaaaattaagcacttactatgtgccagcactgctcgaggggctggggtgttgcagtgaacgaaacagagttcctgctatcaagaggtttaaaaaattagccgggtatggtggtgcacagctgtggtcccagctactcgggaggctgaggtgggaggatcattggagcccaggttgaggctgcaggaagatatgattacaccactgcactctagcctggctgacagagggagacctgtctcgagaaaaataaaaaagacatgagccttgggtctaaagagtgaaaaggctctgtctcttttatggagctcttcctaacagtcagtttggaagatgagcccacccctctttgatgctcttggcttctcatgcctccccctttttgtccctagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgcattgctcatgtgtggtttctctggggtagagaagcaggacgggggggcttttatttttttttctagatgtgggtgctggatgtgggcatacgattggagtgtttagtctttaaaaaaatttttttgtggccaggcacggtggcttacgcctgtaatcccagcacagatcatgagctgaggatatcaagaccatcctggccaacacggtgaaaccctgtctgtactaaaaatacaaaaaattagccgggcatggtggcacgtgcctgtagtccgagctactcgggagggaggctgtggcaggagaatcacttgaacctgggaggcggaggttgcagtgagctgagatcgcaccactgcactccagcctgggcgacagaacgagactccgtctcaaaatttttttgtgtgtgtggagacggtgtctcactgtgttgcccagactagtcttgaactcctggcctcaaatgatcctcctgcctcggcttcccaaagtgctgggattactggtgtgaaccaccacacccggcctgttgacacagatgagctcatgggtccaaatccagcctcctggccacacgccagcaccttaaggtctaggtctgtggcatctggcaggactcctcttgcttctgaggagccacctctgccaccaccattggggatggggacactgagctatggccttgcccctctgagctttgggcttcatgcctgtgagaacatatcacactcattactagccagaaagcagtgcagtaggctttgcagtaggctaaattcattttagcatttagcatttgcattgctaaatgcaaactgcacaaagtttggccatttattggagcctcctgtggaagtcaattctcatctctgagccttagtttccttatctgaaaaaatggattaataaatgatccctgtcccgtagggtcctttagagagttaaaagacataattgagtcaggcatggtggctcatgcctgtaatcccagagacacaccggacagtatggcgggaggatcgcttgaggacaggagttcaagaccagtttgggtaacagagtgaacccccacccctaaaaaggtaaacaagttagccaggtgtggtggagcacatctgtagtcccagctgctcaggaggctaaggctggaggatcacttgagcccaggaggttgaggctgcagtgaactatgatggtgccactgtactccagcctacactacagagacaccgtctctaaagaaaaaaacataggccgggcgtggtgactcatgcctgtaatcccagcacttgggaggctgaggcgggtggatcacttgaggtcaggagttcgagaccagcctagccaacatagtgaaaccccgtctctaataaaataaaaaaattaaccgggtgtggtggcaggctcctgtaatcccagttactggggaggctgaggcaggagaatcacttgaacccagtaggcagaggttgcaatgagctgagattgcaccactacactccagcctgggtgacagagtaagactcagtcgcaaaaaaaaaaaaaaaaaaaaaagacaaaaaaacaacataatgcatacaaagtgcttgctattattgagatcagtttgcctcacattctcctaaaagtccacccctttctgaatatttcagcatcctttcaagtatcctaaaaatgtttaattgcatttaaatataaaattttattttatttgggacggagtctggctctgtcgcccaggctggagtgcagtggcgcaatctcggctcactgccagctccgcctcctgggttcacgccattctcctgcctcagcctcccaagtagctgggattacaggcgcccgccactacgcccagctaattttttgtatttttagtagagaagggatttcaccatgttagccaggatggtctcgatctcctgacctcgtaatccgcccgcctcggcctcccaaagtgctgggattacaggcgtgagccaccatgcccggcttaaatataaaattttaattaggccaggcaaggtggctcacacctgtaatcccagcactttgggaggcccaggcaggcagatcacctgaggtcaggagttcgagaccagcctggccaacatggcaaaacccggtctctactaaaaatacaaaaattaaccaggcatgggtgcctgtaatcctagctactcgaaaggctgaggcaggagaatggcttgaacccaggaggtggaggttgcagtgagccaagatcacgccattgtactgcagcctgagtgacaagagtgaaaaaaaaaaaaaaaaaagataaagtggaaaaggacacccccaaggatataaaacaagttcaaattggtagatgggtcacagcagatacgcctaaaatactaaaaagattgggggggggggaagaaatggtgtacttgaatggatacaaaaattctccaaagggggtgaattttaggcaaactggtcataagacaaattgaaaagccaggcttggtggctcacgcctgtaatcccagaactttgggaagttgaggaaggaggattgcttgaggccaggtgttcgagaccagcccgggcagcgtaacaagatctcatttctacaaaaaatttaaaaattaggcaggcaccatggcttgcacctgtagtcccagctactcaggatgctgaggcgggaggatcccttgaacctaggagtttgaggttgcagtgagctgtgatggcaccactgcattccagcctggccggcagagccaggccctgtctctaaaaagaaagaaattgaaagctgtttgcctcctgcccagcagcgagagaagacgggtggctcctgtcagttctctcccatctggaagaggcccacaatgtcaaggaaggcctggtggagaggtcactgcgtcctggagtgaggctggtcgcagggaggccttcacagaggctgagcctaaagccaggcttttttacctcaggccaggcccccggacactgccctctgcccactttcgcatttcctttttttttttttttttcaaattgttcccctttccccagccctctctccagagaagtggtccagtgctcggtgaccacctccccacactccaccggcccaattacaagtggcgattttctgtttattgctcaaaaacaagaattcagaagcaaaggtggagagactgtgggttggggagatggcaggaagggggcaaggccttgtcccagctctcccctttgtccttcttctgaccctcctggccggagtcaggcctagggccagggcatctgggaggggggcaccttcgtggccaagggaacagtagagctatcgggggcagtccttgaggggtgccctgggcaggaggggctgcaagatttgcagggaggcagagttcccctcccagaatccaaaagccggtagggcggggggcaggcccctcgtttggcaactgagaagaggcggctttgggcggcaggatgctggtttatttactgtaggatctccagggccatcaaagccccctcgtgggatagggagactatttacacagccagggaggagggcagccaggaggcagagaccgggtcccgtatttccctctgcccgaatgaggaggggaggggcgtcctgggtcctgcagctgtagtcttggggttcagatggaaacttcatactcccgcgtatcctgaagacagagagatcaggtcagttgttggagtctgataggggtggaagaggcagccgaatgggaggaggggcaacgatcctgggttttaaagtaacattgacctctaggggctggggggccagtgaatgtgtttggttcatcctacggtgtcgtaaaatgacacaaaaatctgaatttctggcttgtcttgaataattggaagatctgccaattgtgcctcagtttcgactatggggtagagccgtattcttgagatggggcacaagtcctccacttagccacagtcctcaccactccctattgtatacacatggcttgctatgctcattgacatggcctctgggggcagctgagtttgaaattcccaagacagagattccagagaccttgcgagaaggttatggagtcctgggagagccaagtggtggctcttcaggggcaggcaaggtgcttaccccagcttcatacagcgggttgctgaagtccgactccacggtgatggggctgtaggagtgggagcccgagaagccgaaaagggactttccctgaagcctgggaaagggagaggacagaggagcttatcaacaggtaagcccctgagctcccctgacccaggctccagtgccaggctcgcaagacgtctgccctggccggcagtccccaagcaggctacttacttggtgtagtagatgtaaacgccactgccgaggacaatgaccaagcctagaggcagcaggatggccagggccaggttccccccttccagctgccgtgatggatctgtggtctgggtcactacaggaggaggagaggccggtgagctgtggctgggcccggtcctgggctctcccagcctcctgccctgggcctcaaaccctgggcttcatccctccaaggcctggcctcctgccccagcctctgccttgccctcccaacctggccagcctgggtctccacctgtgctctcactgaccttccagttttcggttgtccaggagctcctcataggcaactgcagggagaggagggggaggggatggggtctgagccagggaggggaggaggctgggaggggccgggagcccggtggggctgggctggacagcctggttctctctgccctctgctcaacctcaactttctccctttgtggggaagagagaggagtgaccagcacagggcctttgtcctctttctccagacccctaaaaagtcagggttcctggacagtctgagccaaactagaacttgtcagcgatagggaaactgaggcctattcagagcaagggacttccaagccaaggccccctctactacacccctgagccaatcccatgacctcacacgacccagggcttctggacacacccgtgaggacacgaggccacaggaggagaaccgggagctctgtggggtcgcccattggtctcaaatgtgctacctgactctcccagccctgtcacttcccggacactggtgtgcccctcctgccctgtctggccaggcacctttgcagagtgggggctggctggtccactgggaggggtggccgggcacacaggtgatggtgacctcgccgataagctcaaagccctcatagcagaagaagcgcagagactcgcccgcctggtagtggtgcttgtacagcgtctggtagccattctcgggaacccccgggttcaggcacggctcgtacttcactgcggggagcatgccagtcacgtgccagctgcactactgtgcacggggcagacgggctctcccagggctacccagccaccctcccagggtgtgccccagactcacaggcgcatttggggaccctatcgctccacttgggtgtgcctgtgtcccggctgtagcaggtgagcatggctgccccctcgaggctgtaccctggcaggcagcggtactggacgtgggagccaacggggaagccggcgtccgaggcggtgcggtgcccgttggcaatctcgccagggtcagcacaagtcatgactggtggcagaagaacaaggtcagggggagcgagggccttcaaagatcagcctgggcaacacagagagaccccatctctacaaaaaattgaaaaattagccaggagtggtggcgcactcctgtggttccagctactcaggagttggaggcgggatgatcgctcgaacccagcaggtcgaggctgcagtgaatggtgaccacgctactgcactccagcctgggtgacagagtgagacccagtctaaaaaaaataaaagaaaatctcccagaagcttagggctgggagaggcctgagcctcaggctgtttcctctgaacacctctgcacacacacgcacttcccaccaattcctcagaaggaagagagcatgaattggaaaaacttaaaatgcagtgcatctattttcaggccagaatgacaggcttaatttttttcaaaattcaacgtatgttatatttcaggcttcgtttagtaaacagtttgcttggggaaaccccaagcccctatcctggggtgaaattcaaaatatttaaccaccataccagagcatactagccaaatcccagcagggtgagcccaacatggcttgtagtctgtggaacagcagctgccctctttagagggggcccagctctcctgtccccagtattctcattatgcccagcccagttcactcacatacactccctgccttcaggcgtttgagtttacaaccctgttgtgaaggaatcataatcatagccatttcttgtatataagcctgagctacgtaccctgctaaatgttttacaaacaaatataattctttgtgtgtgtgcttgttttttttttttttttttttttttttttttttttttttgagatgggagtctcgctctgtcgcccaggctggagtgcagtggcgcatctcggctcactgcaacctctgccttctggactcaagagattctcctgcctcagcctcccgagtagctgcgattacaggcattcgctaccatgcccagctaatttttgtatttttagtatagacagggtttcgccatgttggccaggctggtctcgaactcctgacctcaggtgatccacccacctcagcctccaccagtgctgggattacaggtgtgagccaccacggctggccccaaatataattctttgttttggagacgagaacttgctctgtcactcaagctggaatgcagtggtgagatcacggctcactgcagcctcaaactcctgggcttaagcaattctcgcaccacagccttctgagtagctgggactacaggcatataccaccatgcctggctatattttttattatttgtagagacagggtctcactatgttgcccaggctgttctcaatctcctgggctcaagtgatcctcccaccttggccttccaaagcactgcaatttcagatgtgagccaccacacctggcacaaacataatatttaatcctgattatcctgagaggccaatgtcactgtcatctcccttggagcccagggctcagggcggtcaaaggacttggcccatggtcattcagccagggagtggcagagccggaatctgcccagggtcacagccatggagcactggacagggactcagatatgtgggtcctggcacaccttcaggctcaatctgctgccttgggcaggttccctcctgagcccgaggcagcggggccagccgaactctcagccccatccaggcctgatatcctgtgaatccttccaggggcgggaagctttgtccagcccaaatctggctacctgaagcttctccccttggtcccaccattgcttccagatgccacatggaactacagccccatgtccttggggctggcttcctaaaatttggagaaagtaaccagctgccattcctttctgctcttcaattttctttttctttctttctttctttcttttttttttttttgagatggagtatcactcccgtggcgcaggatggaatgcaatggcacaatctcagcttactgcaacctccacctcccaggttcaagcgattctccttcctcagcctcctgagtatctgggattacaggcgtatgccaccatgcccagatagttttttatttttagtagagacggggtttcaccatgttggccaggctggtctcgaactccagacctcaggtgatccaccgcacctggccctttctgctcttctaaaagatacacactcccagctcctttaaatgtcacctcctctgtgaaatctcctgccccagccctgagaaaattagcccactgctctccccacagcacttcgccacgcccagggcagcatgcgccctgtgaactttccatctgctcttcacaacctcagtcctacttcgccgatggggaaaccaagcctcagaaatgctaagtgcctcgcccaaagtcacccagtgatcaccaccctgcgtatccctcccagactgcgagctccataagagtatggaggggcttgaacccccttcgcctaaccccaacccagcacggggcttcaatgatggcattcaaataaaccaagtgctctgacaagccttggtcctagcaaagtggctccctacaatttcaactgataggactgcgggattggggcggggcgtaggacaggaaggtggagccaagtgtggacccggggagcccagtgggaacctggtcggagcccttttaggggccaaactcagatgccgcagaggaggggtcaggaggggacggggcggggccgtgagacgaggaaacagggaccgagcccaggtcggtgcaagaaagagggatgcagcccggagaagatgagagggagacccagaggggacagtttcggggaaccgggcggaggagtgagaactaaagggcatgggggcaggccttgaagaagatccaggaaggaccccgagcgaagggatggaacccagaaagcacgggggtcgggacaggacaggccgacgacggggcccacagggaaggggcggggccgaggggacgcgggcggggccggctcactcttttggcaggcgggcggcgcggcgctccaagacaggtcccactggcaagtgagaatgtcggagcctagcagctcgtagccaggctcgcactggtaggtgagcaccgtgccccggatcaggtccccgtgggatgccgttctccagccccactccggaggtggcagctcggggcacgtgtcgttcctcgggacctctgcaggggagggaaggcgagtttggaggctgcgttttaactgcgggctcccttccagcctcggaggctttgctctgtgccccctcccgggatctgtctctctctctctctcttagagacagggtttcctgtcgcccaggctggagtacagtggtacaagcatagctcactgcagcctcaacctcctggcttcaaacgatcctcccgcctcggcctcccaaggccccgggataacaggcgtgagccaccacgaccggccacctcccgggatctctggcctgcccgacccctgcccatcccgggactctatccctcagtacctttgaagtgcaatacgaagccctggcccaggcctggatttgggggcccgggcggtgcctgaaactgcagtgtgaggtcgggcccagaggagagaaggcggcggcgcggctgaggtccccgcagctgggccaagactcgggcgctgggaccgtccccgtcgaacagcgtcagcatgtccccttcccgcacattcaatctgcagggggtgagaccaggcaatggggcggggctgcgactggcccctcccatccagctctgccccatcctcaactctgctcattggtagcccctcctactctccagccccgcccatattctcctatcccaggtctggcgccgcctccgttttgaccaaccatggtttctcctatgctagtgcctcagggttcccctattctatggctcctcccatgtcctactacccaatccctaagcttgcacattactaactccgcccactgtccactccctcctccatcaccatgagatccacagcctagcccaactccagctctggccaatcacagaccaaattcgctaacgccctacacaactctaggccccgcctgagtacctgctttgaagccacgcccacttcagcttctgtgccatctcatgacactctcataccaattcagctcactggattctccccagacctccccaacttgctggtgttaacgcaacagtttgggtctgtgtccgtggaaatagctccaggggaagcctcagaaacctccaaagagtgagaggcaccaggccagagccccttgttcacagtggcccctaaggaaggctgcattgccctatttatttgtccgaggttgcctggctaatatgtgatttgagcccagctctctcacgtctatcctgtacccttagtgcaccagcctatccaccgaattctggatagatacgcaagagccagacaggctcagaatgcaggctactgcattggcataccacactttgctgagcctacacccgtcgcaccctctgcaggacccaaacatacatctcaacttggagcaagatgcgcttctcttcctggacgtgcacgccccacacgcagtcttggcccgggctatagctctggggccagtcgggagagaggaccacgccagctggttccgacagctcccctccacacatggctagggaaaaaggggtgtcaggttcaggacccaggtgggcatgctgtcttcatttctccacagtcctcaccactcgtgatgcgtgcaccacatcacctcgcttgtttcctattacctatgatccacctgtttcttttattcttttattttatttatttatttatttttaaattttttttgagacggagtctctctgtcgcccaggctggagtgcagtggtgcgatcttggttcactgcaagctctgcctccctggttcacgccattctcctgcctcagcctcccgagtagctgggactacaggcgccgccaccacaccctatttttttttcttttttctttttttttttttttgtatttttagtagagacggggttttacggtgttagccagaatggtctcgatctcctgacctcgtgatctgcccgccttggcctcccaaagtgctgggattacaggcgtgagccaccaggtccagcccctatttttatttttttagacagagtctcactctgtcgcccaggctggagtgcagtggcgcaatcccggctcactgcaatctccacctcgcagactcaagcgattctcgtgcctcagcctcccaagtagctgggattacaggcacgcactaccatgcccggctaatttttgtatttttagtagagacggggtttcactctattgaccaggctggtctccaactcctgacctcaggtgatccgcctgcctgagcctcccagagtgttgggattacaggcgtgagacactgctcccggctttatccacctgtttcttttttctttctttctttcttttttgagacggagtttcacacttcttgcccaggctggagtgcagtgctgcgatctcggctcaccgcaacctccgcctcccgggttcaagcgattctcctgcctcagcctcctgagtagctgggattacaggcatgcatcaccatgcccagctaattttgtattttaagtagagacagggtttctccatgttgatcaggctggtctcgaactcccgacctcaggtgatccgcccgcctcagcctcccatagtgctggtattacaggcgtgagccaccgtgcccagccatgatctacctgtttcttgccgcatctaggtcctgttgtgttcaatatccagtcctgctcttaacaaaccctgcccactctccagcctgcccaatctgtgacttaacccaacagcagttctcgctcttgaagacatttgggtttgtgacccctgcattcagtaacaagcccagcagttattcagctaagaaaacagcctctgaagggacagggatttacccaaggcttgggtggatgaagtctggatgtgcagccttcctttctgaacggccttgctgggatccccagttcagggggcaacgtggactgaaggacatgcctgcgacaaggaaggctcacctttgcaggccggctctgtgtcgttccagtggggttctgtgggatccacacattcgatggcattggggggcccagggggctccagggcatatcctgggaggcacgagaaggttgccagtgcccctgggcgatactcagggtccgtggtagtgacatttccatgtgccaggaagggggcgaagcagcgatcctcctcaaaggctgggaaggagtcagtcataacaattaagcattaggacaggcctcaagggatcttaaattggggatgtgggctgaattggggtgttctttggccactcactgggcttttttttttttttaaacagtcttgtgctgtcgcccaggctggagtgcagtggtacaaccttggctcactgcagcctctgacttccaggttcaagcaattctcatgcctcagcctcccaggtagctgggattgcaggcgtgcaccaccatgcccagctattttttttttttttgagatggaatttcacacttgttgcccaggctggagtgcaatggcacaatcttggctcaccgcaacctccgcctcctgggttcaagcgattctcctgcctcctgagtagctgggattataggcatgtgctactacgcctggctaattttttgtatttttagtagagacggggtttctccaggttgatcaggctggtctcaaactcccgacctcaggtgatctgcctgcctcggcctcccaaagtgctgggattacaggcatgagccaccgtgcctggccaatttttgtattcttagtagagacaggggtttcaccatgtcggctaggctggtcttgaactcctggcctcgagtgatctgcctgcctcagcctcccaaaatgctgggattacagacatgagtcactgcgcccagcctgggtttttttttaatttttttagagacagggtctcactctgttgcccaggctggagtgcagtggtgtgatcacagctcattgcagcctagatcttctaggctcaagtgatcctcccacctcagcctctctggtagctgggactacaagcatgcacaccccacccagcagctcattttctgattttttttttttttctgtagagatggagtttcaccatgttacttaggctggtctcgaactcctgacctcaggtgatccgctggcctcggcctcccaaagtgctgggattacaggtatgagccattgccctggcgttggtgggtttttaaaaactgaatgccactgggtttagcattcactctccagactgtcaaaaaaagttctaacactcctcattcacatatttatattgcctccctggcctctggagggaagccactgagctagccaaatcccagccaccattctacagagcggaggtccatagaccaaaaagccacttgctcaaggtcacacaaaagacaatggcaaaagcaggtctcaaacccagatggtttgattcccagccacagatacttggctctggaaacagcagagatagcgggtaaggggaggggtgccttcagagaactggctggtgtaggtgtattgtctcctcagaaataacagttggattctgatcatccatgctgttgctgaaacccaaaatttcagctaatgcaaaaactactcagtttttacttcaagtcagcaaaagtgaacatttgtagagcatttgagtttctgcccacctgatcggatcttagctgcaaaactccctgtaagttaagatttaggtgcctatgataccaatgaggaattcttttttttttttttttttttttttgggatggagtttcgctcttgttgcccaggctggagtgcaatggtgtgatctcggctcactgcaacctctgcctcccaggttcaagtgattctcctgcctcagcctcccgagtagctgggattacaggcacccacaaccacccccggctaatttttgtatttttttagtagagatggggttttaccatgttggccaggctggtctcgaacacctgacctcaggtgatccacccgcctcagcctcccaaagtgctgggattataggcgtgagccaccatacccggccttttttttttttttttgagatttttaattttattttaatattttatttttttattttttgagactgagtctcgctctgtcgcccaggctggagtgcagtggcatgatctcacttcactgcaaactcggcttcccaggttcaagccattctcatgtctcagcctcctgagtagctgggattacaggcacgtactaccacacctggctaatttctgtgtttttagtagaaatggggctttgccatgttgcctaggctggtttcaaactcctgggctcaagtgatccacctgcctcagcctcccaaaatgcggagattacaggcatgagccactgtgcccgggttattttatttatttttaaaaatgaggccagatgcagtggctcacacctgtaatccccccactttgggaggctgaggcaggtgaatcacctgaggtcaggagtttgagaccagcctgaccaccatggtgaaactccgtctctactaaaaacacaaaaattagctgggcgtggtggtacatgcctgtaatcccagctactcagaaggctgaggcaggagaaccacttgaacccggaaggcggaggttgcagtgagccgagattgcgccattgcactccagcctgggtgacaagagcgaaactccatctcaaaaaaaaaaaaaaaaggaaaaaaatgagacagggccttgctctgtcacctaggctggagcgtgcaatggtgggatcacaactcacagcagccttgacctcctgagctcaagcgatcctcctgcctcagcctcccaagcagctgggaccacaagtgtgcaccaccacacctggctaattttttgttttgttttgttttgtagagacaaaggtcttgctatgttgcccaggctggtctccaactcccaggctcaagtgatcctcccatcttaacctcccaaagtgctgggattacaggcgttagccattgtgcctggccacagtgaagaatcttaaactcatagaatagcagtggcctacaactctggagtcaggactcacaacttgctattttcggtaaaagatctgtgctgtttgcactttaacactcccagaatctatcccgcaattcatttttgcagatccactgttctatttcactgttacttaacctgcaaggtatcatgtccaaatcctacccatccatcacagccgagtgccaattccatttctcccatgattcatatcaaacactagaccctcctatctctaagcatttcatctttttggtctctctcttgctactgtttatacaactcctctgtttcagccacaatgaaattctgtttcccagacataccaggcatttccctacttgctgtttctcaaagttcctctctttccttttcttttcttttcttctttttttttgacagggtcttgctctgttgcccaggctggagcacagtggtgcaatcatagctcactgcaacctctggggttcaagtggggttcaagtgatcctcccacctcaaccttccatgtagctgggactagaggtgtgtgccaccacacctggataattattacttttttttaatttgtagacacaggatctcactatgttgctcagactggttctcaaactcctggcctcaaacaatcatcccaccttggcctcccaaagtactgggattagagacacgagtcaccacaactggcctcaatcttcctcttttaaaatatcctctgttggctgggcagggtggctcacgcctgtaatcctagcactttgagaggccgaggtgggaggatcacttcagctcagtagttggagaccagcctgggcaacatagtgagatgctgtctctacaaaaaatgtaaaaattacccaggcatggtgccgaacgcttgtggtcccagctactagggaggctgaggcaggaggatcacttgagcccaggaggttgaggttgcagtgaaccatgatcgggccaccgcactacggcctgggcgacaaagcaagacctatttcaataataataataataataataaaataccctctatcctttaaggccaaggtgaaatgcctcttcctccatgatcacttccttgtttctaccccttcacattcattcctcttcttctggtaacggcatcccaattttaattttgggacgcaggccttccccactcccagtccactaggttaagttggagcccaccagggaaggccacgtgaggcagattagccaatcccaatactcccttctcctagctcagtgattggctcaggctaaggccaaccaggatcttagtcaggtcaatgaacgcctctcctggcatttttgctgagctctcaggaaatatatgagtgttctctctgatgaggttactcggttggtggtatgggctggaggaggtggcttacacctgtaatcctggcactttgggagtcccacatgggcgaatcacttgagcccaggagttcaagaccagcctgggcaacatggtgaaaccccgtctctactaaaaacccaaaaattagctgggcgtggtgatgcatgcctgtaatcccagctactcgggaggctaaggaatgagaatcgcttgaacctggaggaggggggctgcagtgagctgagatcgcgccactgcactccagcctgggcgacagagaggaactctgtctcaaaataaataaataaataaaaataaataaaaactaaaaactgtcaggcgcagtggctcacgcctgtaatcccaacactttgggaggcggaggcgggcagatcacctgagttcgggagttccagaccagcctgaccaacgtggagaaaccccatttttactaaaaatacaaaattagctgggcatggtggcgcatgcctgtaatcccagctactcgggaggctgaggcaggaaaatcgcttgaacccgggaggcagaggttgcggtgagccgagatcatgacattgcaccccagcctgggcaacaagagcaaaactccgtctcaaaataaataaaggccgggcgcggtggctcactcctgtaatcccagcactttgggcggccgaggcaggcggatcacaaggtcaggagatcgagtccatcttggctaacacggtgaaaccccgtctctactaaaaatacaaaaaaattagtcgggcgcggtggcgggtgcctgtagccccagctactcgggaggctgaggcaggagaatggcgtgaacccggaaggcggagcttgcagtgagccaagatggcgccactgcattccagcctgggtgacagagcgagactcgtctcaaaaaataaataaataaataaataaaataaaaattaagttggtggtatgtaagtcggcagctatgtccatcacacagggaaagtgcctaaggatgaagccagcacagaggaaagaaccgagatactgagataactggtctctgggctatgtacctggatccagacattcatgaagcttaaacagagaaggctgcctgggggaaggagaaggggtccctagaagagatccttgcagttttggggcagggaagcgagtcacgtttcaaggaacccagcacggagatgaacaggcatagagtttgtgcttccgactatgcttggtgtcaggaagaggggaaggtgtggcggttggggtcctgtgggggagtgggtcacttaccttcaaatcgaaggcttaacagcaggggattggcaggtgtctctgacagcagctccacgtagagggactgggcgtcactgatgagaccccgctcggggacatcgtccatgtccgaatcatagatcacgggggatagggggctgccccctgagcgcaccatcagcctgggatggacagaaacgtgaccaggagctcaatctccctcacaagctgcctcaccccttgcctgctttcctaacttatttttatagctgttatcatcacacataactatatgccacgcactcttctaagcccttacacattctatctcatttaattttcacaagaactcttgagtcagacactattattatcctttattttatagatgaggatattagggcatagaaagatcaagtaacctgtccaaggtcacagagcaagtagtggcagggctgagataccaagttgctaggtaaaggatgataatgatgatgaagatagcagatgcttgaccaggcatggtggctcagctcacacctgtcatcccagcactttgggaagccaagacgggtggatcacctgaagtcaaggagttcaagaccaggctggccaacatggtaaaaccccatgtttactaaaaatacaaaaattagccaggcatggtggtgcatgcctataatcccagctactcaggaggctgaggcaggagaattgcttgcatctgggaggtggaggttgcagtgagctgaatccgtgccactgcactccagcctgggtgacagagcgaaagtctgtctccaaaaataaataaatagataaataaggccaggtgcagtggttcatgcctgtaatcctagcactttgggaggctgaggtgggtggatcacgaggtcaggagatcgagaccatcctggctaacacggtgaaaccccaactctactaaaaaaaaaagtacaaaaaattagccggacgtggtggcacacgcttgtagtcccagctactcgggaggctaaggcaggagaatagcttgagcctgggagacagaggttgtagtgagccgagatcgcaccactgcactccagcctgggcgacagggtgagactccatcttaaaaaaaaaaaaaaaagaggatagcagacacttttatagtgcttattgtcccaggtgccattctaaggactttatataatttcagcacttatcctcacagaaacctgaagagggaagtattgttatctccattctacagatgaggaaactgaggcacaaagaagttaagtgatttgtctaaggtttcacagctacacttcctaagaaagtcttaggactggctgggtgtggtggctcacgcctataattccagcactttgggaggccaaggtgggcagatcacctgaggttgggagtttgagaccagcctgaccaacatggagaaactccatctctactaaaaatgcaaaattagctgggcatggtggtgcatgcctgtaatcccaactaatcaggaggctgaggcaggagaatcacttgaacccgggaggcagaggttgcggtaagccaagactgcggcactgcactccagcctgggcaacaagagtgaaactctgtctcaaaaaaagaaaaaaaaaaaaaaaaaggcttaggactaagctgtgatgcatatctcaaccaggatccaccccagctgtgtccaagtccccacttagcctccctacttccctgaggtggggacttctttttttttttttgagacggagtctcattctgtctcccaggatggagtgcagtggtgcgatcttggctcactgcaagctctgcctcccgggttcacgccattctcctgcctcagcctcccgagtagctgggactacaggtgcccaccaccatgcccggctaattttttttttttttttttgtatttttagtagagatggggtttcaccgtgttagccaggatggactcgatctcctgaccttgtgatccgcctgcttcggcctcccaaagtactgggattacaggcatgagccaccatgcccggccaaggtggggacttctgacccaagacccagacccttaccggtcattgtcctcatccagcgagaccctttcaaagtgcaggtgcagccggcgcccctcagctgcttcaatgacccaacggcaggtgaggttgggccctacggctcccccaggctctggggacacgatgcggcccagggtggcattgtggatggtgccaccacaggatgctgtgggcagaggaggggtacgttaaggccagcctgaggtgaactgtccttctcctcggggcctcggcccgttttcagaactgttgcattcacacatttggctgggacccggcccagggctggcctctgtcccatggagtcactccagaggatgggaccttctccaggcatgagccaggaaagaaaccagccccggtacgggagaaccccaggattgacacctcctaggatggagacaccactaaaatgaagactctccaactgcggatactctaggatggggagttacaaggatccctaaaattcaaagcctcagctgggaaatcttcaggacaggactttcagagtgaagacaccacgggatgggaatcccagtaagaggctctctaggatagaagccctctggacatgaaccctaaaaatggcttcctctaggatgaggacgctaccccagaagggacctccagaatggtgactcccaaaataaaatctccagtgggacaccccgagatggagaccacccaaggatggagaaaccccaaggagagagaccctccgcacaaagagctctggctgcagaccccaggatggggactcctcagggtaaacaccccttcagaatgggttttccccaaaggtggacacctggacacccccgagataggaccctcccaatggggttcccagaacagatgccccacccactgtggcaggagactcacccatgcagctgggggtttcaccgttccaggatggccgggtgccattgaggcagatgagggtctcctctccctgcagctggtagcccgaatcacagtgaaaggtggcagtgcccccagggtgcaggtccgtcacactcacgtccccatgggccggccggggagggaagccacagctcaggaggtaggctgcaccagacagacagcgggtagcagggctcactttcccatgccaccctctcatactgatcccccagcacttcccccctctcctttcaggccaaccttccaggggcacacactggctccatactggcgtacataccgagaaataagagctcctcacacaggcaccttgcctcgcgaacaggaaactccaacaccccttatctcccccactcattgtaattcaccctcgttggcccccattttatagatgaggtatctgaggttcaaacaagttattctggaccccgctactcatttgttgtgtgacttcaggcaaatcaatgaactactctgaacttcatccagctgtaataacagtatttgcagagcttgttcagctcccaaagtgagtccacacagagattttgaggtcagcagacaaagattatgtgacctggctaggcatgctggctcacgcctgtaatcccagcacttttggaggccgaggcaggtggatcacgaagtcaggagttcgagaccagcctggccaacatggtaaaaccccgtctctaaaaaatacgaaaattagccaggcgtggtggtgggtgcctgtaatcccagctacttggtaggctgaggcaggagaatcacttgaacccaggaggcagaggttgcagtgagccgagatcgtcccattgcactccagcctgggcgacaagagcaaaactctgtctcaaaaaaaaaaagattatgtgacctgttttgcaggtgtgaacactgaggctccaagttattaaatgtctcttttgatttttcttccctccacacacacagcctttcttccaccaaggtgccctgtggtataccctcagctcctcagcttccatccagaagaaccacttgaaacttctttttttttttttttttttttttttttttttgagatagggtctcactgtgttgcccaggctggagtgcagtggtgtgatcatagctcactggaaccttgaactcctggcctcaagcaatcctcctgacccagcctcccaagtagctgggactacaggtttgtgccaccatgccccgctaatttttaaattttttgtagagatgacatctcagtatgttgcccaggctggtcttgaactcctggcctcaagcaaacatgaaacttgttgaggaaatttgactattttgtctttttgtttttgtttttgtttttgaggagaagtctcactctgttgcccaggctggagtgcattggcgcaatctcggctcactgcaacctccgtctcccgggttcaagcggttctcctgcctcagcctcccaagtagctgggattacaggtgtgtgcgaccatgcctagctaatttttgtatttttagtagagatgggattttaccatgttggccagggtggtctcgaactcctgatctcttcagacctcctgacttcactttcactgggggattcatttacaggccactgagtattaagatctttaaagacaaaatagtctttaaaggcacagtggctcacgcctgtaatcctggcactttgggaggctgaggcgggcggatcacctgaggtcaggaaaaagacccaggccttgtcctcaggagtccattgtctactgagatgaacataagaacaaccttctagaacaaagtggtttcaataaatggtagctttgggaatggctgcccatgcccaacagaatcaagtctgaatgctttagtttgacattcaagccccttccatagttaaatgcagcccagcacattccaggttcagggttgatctcccaagaccgatatagcctacacaacacagttttgtgactccttaattttccacctccatattttcgcttgtgctctccccctactttctcatcttttaagagatcagactggggggcttatgtaccacctcttccaggaagccttcctgactctacatctctccaacagttacttgttctcttacctgtacacagtcctgcatgcatgattttgtcatcacattaaccattgtctttttttttttttttttttttttttgagagggtctcactctgtcacccagtctggagtgcagtggcttgatctcagctcattgcaacttttacctcccgggttcaagtaattctcctccctcagcctcccaagtagctgggattataggcgtgtgccacgactcctggctaattttggtatttttattattatttattttattattattattttttgagacggagtattgctctgtcacccaggctggagtgcagtgacacgatcttggctcactgcaacctccgtctcccaggttcaagcaattctccggcctcagcctcctgagtagctgggattacaggcatgtgccaccatgcccagctaatttctgtatttttagtagagacggtgtttcaccatgttggtcaggctggtctcgaactcctgacctcgtgatctgcccgcctcggcctcccaaagtgctgtgattacaggcgtgaaccactgtgctggtattttcagtacagacagtgtttcactatgttggccaggctggtcttgaactcctgacctcaggtgatccacctaccttggcctcccaaagtgctgggattacaggcgtgagccaccatacctggcctaaccactgtctacactggcccaagccttatttattttgtgtcctaaaaggctagtctatgaggtcaggagttccagaccagcctggccaatatggtgaaaccctgtctctaataaaaatacaaaaaattagctgggcatggtggcacacgcctataatcccagctactcaggaggctgagacaggagaatcgcttgaaccaagggggcggaggttgcagggagctgagattgtgccattgcactccagcctgggcagcagagtgagactccgtctcaaaaaaaaaaaagggctagcctggctgatcaatgggtgcagccaagaggcagcatggatcggtgcaaagaccactggatttgtcatcaggcagacctgagttccagttctagctccagaacttactaactacatgcctttgagcaggtgacttcatctctaggggcctctcacctattaacggcaataataattcctatcagggaagattggcctgaaaattaaataaaagaaacacgcaaagcacctggcacatagaagctgctgagaaaacgttaatcacccacccctcagcctcaattaatgaatgactgggagccagggactcggggatctgttgtctggctgcaataaacgtgcagatggttgagcaatctacataacctttgagtcttttccttcctttgagagatagaactgacaatggccactctcagggtttctgtgagaagcaaatgaaactaaggttggtgaaagggctttgtaatgggaaagtttgctgaacttggggtgaggggtgaaggagactttggcttttcagagaaactaatgaggccactctggaccagaggccccagctagtgcaggttgggaagggctgaaacagggccttggtcccaaaggtacccagtgcagctgcgaagcagggaagactgagcaatgaaggccaatttgtgcaatagtcctgcttccccaaatgttccacttagcctaaggagtcctattttcagtgccctggggaagtggctgcttaaaggagccagtggggagccatatcttcagatttcacaatatctgaaatccagcacttggcccaggccctccaggaatgctcttgctccccaataaccaggtccctactgccaaatacacgtcccccagcttgctggcccccgatgaataggcacctttgctatgcacacatgagcccctaaggcaggtcctgagcagaggcctcaaaagaggctggagaggacatgagaataggattcagggtgtaccctgcatgaggcacacaaggcatctgcggtcagcagagctttcaaggagggcagagtgcgtgacaccagccaaggccatgcggtgatgtgaagggggcattggcccgacacacagttctctctgtctccatgaagcataggaagacagtggggtctggaacagggcactggctgggcccctttcctcatgcacacatgtctgctagaacacacccttgtactgtgggaaggttcccgcacacacaggtaagcatggatgtacacacatgtgcaggtcatctgtcataggtcctaacaaatgcagtcgtgcgtgaatacagcccccctttcctgcccccagaagtcagaaggatctttaaattgcaaatctgaggctttcactttcctgcttaaaacatttcaggccaggcaccatggctcacgcctgtaatctcagcactttgggaggtcaaggcaggaggatttcctgaggtcgggagttcgagaccagcctgaccaacatggagaaaccccgtctctactaaaaatacaaagttagccgggagtggtggggcatgcttgtaatcccagctactcaggaggctgaggcaggagaatcgcttgaacccgggaggcagaggctgcggtgagccaagattgcgccattgcattccagcctggccaacaagagcaaaactccatctcaaataaataaataaataaataaataaaattcaaattaggaggcctggcgtggtggctcatgcctgtaatcccagcactttgggaggccaaggcgggtggatcacttgaggtcaggagttcgagaccagcctggccaacatggtgaaaccccatctctactaaaaatacaaaaattagccaggcgtagtggcaggtgcctgtaatcccagatactggggaggctgagacaggagaatcatctgaagctaggaggcagaggttgcagtgagctgaggtcatcaccactgcactccagcctgggcaacaaagtgagactctgtctcaaaaaaaaaaaaaaaaaaattcaaatatctgcctgtcacacctgcaggttgaagtagtctggactgcttactgaagcagataaggctctttatggtctgaatctgacctgcctcccagcctggtctctggcccatttccccttcacccgcttctgtgctttgaaagtaatagcagtgactgacagttttgagctctcactgtgtaccacacgctgtttgtgtttttgtttgtttgtttttgagacagagtttcacttttgtcacctagcctggagtacaatggcgcaatctcagctcaatgcaacctccgcctcctgggttcaaacaattctcttgcctcagcctcccaagtaactgggattacaggtgcttgccaccatgcctggctaatttttgtaattttagtagagatggggtttcaccatgttggccaggcaggtcttgaactcctgacctcaggtgatccaccagccttggcctcccaaagtgctgagattataggcgtgagccaccacgccaggccacacactgttttaaacacttgacatgtattaattcatttgatcttccccataatactaagtattgtgatccctatttttcagatgagatcatgaggcacagaaaagttaagtaacttgtcccaggtcacacagctaggacaattctatcttccatgctgaattccttcacctcatctgggggtcatgtcttctctctctgggtcttggagtgtgctttttcatccacttagccatctgcctccctccttctctccctccctcccaccctttccctggcgaatttatccttcaggtctcagcttagtcatcatctcctccaagaagatgtccccatattccttgggagaaatttaggtcccttggctatgtgctgcccccgctggtgtttctgccatcatattccttatctccttgaattataaccatcctgattactcatctgtcttcctacctagattctgagctcgttgaagccagatttacacctggtttgttcattcctccttcaaggctaacacagggcctggtatgaagcaagcacttgataaacatttgttggattcaatggatgaattgtccctcggatgtgtgcacagatctgtgagtgtgtgagataagtatgcatgggtctcctctgagggccctgccccccagggtcgcagtcaggaggaaaagcccccttcggcaccctgtgcttcgatggttcttaaagatgtcccctctataggccgggcacagtggctcttgcctgtaatcccagcactttgggaggctgaggcaggtggatcacaaagtcaggagatcgagaccatcctggctaacgcggtgaaatcccatctctactaaaaatacaaaaaattagctgggcatggtggcgggcgtctgtagtcccagctacttgagaggctgaggcaggagaatggcgtgaacctgggaggcagagcttgcagtgagctgagatcacgccactgacctccagtctgggcgacagagcaagactctgtctcaaaaaaaaaaaaaaaaaaaaagatgtccagtgtatgcagtatggcccctgcccttccagcagcaccctcaaactcctcaccctgatagtggatcctgaagccaccgccccttgggacccgtgggctctggaagtgcagaagcagccggttggttgggctccgaaggacttgtccttctccaagcatggatgagttggccaggagtcggggggccaggcctggggatcccccaccagccagcaccaggagctcctcttcctgtgacaggttcagcgtctgcacctagagaagccagacacagacccgccagggcaagtcagccaggtgtttgacttccaaagcccctgtcctgtgcctttgccctgtgtgtagcagcccaaaaggcaccacgctgctgcccaagttgtagaaatctagaagagtttttgaggtcacctgagtcatcagacaggttctttggctcccaggccaaacccgtgcacacccacagcccagaggaaaaggcttggaagctgcacagtcacatgctttggtccagttacctggatctcaatgccgtagccagggtagacatggatgctgtaagtgcagtccaggagccccagggtgcggctgacggggctccccagatctggagactccacatacccttcgccctcggagatgttgttattacacagaactgaggagatacaaatggctgggatggaaggaatgcctgtgcttttgccctcccagccaagcaactctggccttcatctcccttctccttagcacttctcatcatctttttgttttgtttgagacagggtctcgctctgtcacccaggctggagtgcagtggtgcaatcatggctcactgcagtctcaaattcctgggctcaagtgatcctccctcctcagcctcccgagtagctgggcccacaggtgcacatcaccatggtgagacaatttttaaaactttttgtagaaatggggtcttgccacatttcccaggctggactcaaactcctggcctcaagcgatcctcctgccttggcctcccaaatcactgggattacagctgtgcgctgctgtgcccccctcaccatcttttatttttttatttttatttttttaagatggagttttgctcttgttgcctaggctagagtgcaatggctggatctcagctcaccacaacctccacctcccgggttcaagcaattctcctgcctcagccttctgagtagctgggattacaggcatgcgccaccacgcctggctaattttgtatttttagtagagacagggtttctccatgttgctcaggctggtctcgaactcccgacctcaggtgatctgcccgcctggcctcccaaagtgctgggattacaggctagagccaccatgtccatcactatctttaagcaatgctccctctcccacctgagccagaactccctttcccaactgttatatagctgaaacaattggaacactgcctggtacatagtaagggtacagaaatgctacctttgttattattattctcccatctgtacccaggactccttccacagttcccagcagcctctctcccatccatccccagcgtgtacctctccggtcctcccacccccatccccttgctgtcgcctcacctgggctggtcaccgtagtggtaacagttgtcgtggtgatgatggtggtcgtcgtctcctcctctcctccctcaggcccaaggggaggccctggggaggcagggctgggtgggggtggggctgtggttcctgggggcggggtcagcagttctggcgcagtggggcctgcccccctgaccccgttaggggtgacggctgttgtcagaggccctgtccccggctcagtggcccgtggcagggagggcactgcgagagtctggccggccggaggggtggctagcgtggggtcccgatcagatcctgggacagtgcagggaatatcagagcacaggaggagcacatggaggaccttgggtggggagcagggctgagggaagctaggggttcccctgccataccacaaaagcctcccgcacaaggtacagcaccccccacctttcccttccccaccccagcccctacctcctcccaaggcttccacagcctgagtcccccctctttctcttctggtcccttctctccacccagccccttccaccctgatactcctctccctgagcctctctctctgcctcctcactcagatcacgttctctctctggttatctcctctctcctctgtctcattctctctcgaactctttatttccccatttccctgtttagtattctgattgcactctgatttcatgattcgagatccactagtttttgtgtttcattctctctgtctctgtcttccaccatttctctgagtctggttctctgaatttccatctctgtttctatgtgtctgtttttctgtctgactgtcacctaatcattctgtctctgtctctctggttctgtctgtgcccaggtttgactttctctgacagtctcgttctgtgttccctgaatctcacaggaatgcaggctctttcctctgcagtctctctctgcctgctcttctctagcctggctccccatctccctgagcccatatccctccctctgcctctaggccactcctgccactctgggggcctcacctggcaggtagcccatctctgggcccctcctcagcagggccccatgaagcagttcagccagggcctcagaggccaccgtgggggtctcacttccaggctctggcaatatctcctcctccttcaggggcagacctaggaggtgaagttgtgtgagcttctccacttccccacaccccttccttctccagagagatattttctagaactcttcctccctcctccatcagctgggcctgcaggggctcagatggtcccaggctcgactgagggccaagatcggaggaggggctcccagctgccctcatactcccactcccacacctcttctctcccctcccctctcccttctccctgggctgtgtgggccttcattgaacaccttagctcttatggaccctggacagcgccagcaaggcagaggggtcgccggtgctgccttccctttcacctcagtggtgatctccccccaaccctggggctctgcagaggatctggccgcacctcccagcccttgcttccgcagtgcctggctttctctctgggtttctgtctctgcagtgtggctgtcttttctctctctctctctctctctctcccccccaccctctctctctctggtcctctgcagtctctgcctccttccctggagtctggctgggggtcagagtgggggactgaaaatctggtctttgagccctgcctctgctcatctgtctttgtccattcatccaagaacagttgtgtgtacagcgcctggcatctctctcagcacctccatctcccacccaggtccctccatgcttctgccgcctccgcagacatccccccaactttcccagccctccttcttggatctagcccctgagacactgctaaaagcttctctcattcatttctctgccttctcaatattgagggttaaggggcttcgggttcaagcctgaaagctctggcttgccccttccccatcagctgtgcctctcccctcccccatgtgctcggaagacccaggatattaagagaaaggagggtggaggaccccgctggacgccttcctggggcccacccccacagtctcatgtccttaccctggatccagggacagctcagcagaattaggaacagcagctggggaggcggcgggtgctgggccctgggagtccccatggcgactcaccccgatctctctcctctgtgcctctctaagtaatctggctgccacctttcctccgtctccgtttatctttccctttaattgttttttttttttttttttttttcctcgtaggagtcagcaaagaaagacaatttctctgccccttgggatggaggggcagaattgggctaggggtcgcctggagcccacccccctttgctcagtctcctctgtcctcttctcgcggctctgtggtggagggggcgcggctccggctgcagggggtggggccgagagggccgaaggggccgggtggcctgggttaccctcctgctcaggcgcctgggtccactgggctgtctggaccccaagctaggggactggggaggagaaagacagcttctgggggtttagggtggggtcgaggatcgagggggtctccactgggctctagcggggcttgtcggggaggggaaggggtgggttggggaactgggagagccgaagctcgggcactggagctgcgggagggagaagctgagaaaggtatcgagcccacgtcagatcctggggacgggcggagggaggggcctgggatttatttgacggggagggaggaggaggaagtgcagatggaggagggagggatcatacgagccagggccgtaatcctcactcccgcggcccctaggggaggcaaaggaaactctctggtcccagcagtaattagccccctccgcctgccattccagcacatctggaatctgaatctcctcttcccagggtgccgaggggctgcatagcttggttcgcgcctgctaggcccccaattatgccccctgttcacattcagacctcccaaggggcttcccttccccttttacagtagctcgggtggaatgggctctccctcctccaggggaatagagagcttccacgattgtgacaagtctcgtgggtgacgggccggggtttggggaggagagacagacccctcctcttccataaaccctgaccccggccagctaacaggcggcctcggctctgattttccctccggagcgcccttttcagcaccagcggcgcgcggacagctcccctcgccccgccggggcgggcccggcccgacgccgcccgcgattggctgaggccgctttcggtgtttgccaggctcgcgggctcccgggctgcctagggccagcgggagtcacaggccgaccgaccgacggaccagccgcccgacggactggcctcagcatccttgcccgcagtcccgggcgcctgcccagccgtcagtccgcgctcgccccgcccctcaggccccgcccctcaggccccgcccgatacgacccgccccttctttcgcattgcgggacggctggaggctggcaccgtggcccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcagggtgagtgggagcccaggaaggagcgagtaggagagagggagcgagagccaggcaggaccgcagggtcggggctagtgaggagcgagggcaaggagagagcagtgaggccggagagaaagaagctgccgcggaggaagacaggctgcgggttcccgggactgcaggtccaggcagggtaggaaccgctgcccaggggagctaggaggaagcggggagagagagcgagcgaaaagcgggggtggggaggaaagggggagattgaggtgggagagagaagcagagcgagagagaggaggctgctggaaggagaaagaagagggtgaggaggcgacagagggagaggaggaagaagaggtagaaggagagagaaaggggagagaaaggagagaggagggttggaggtgcatgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggtaagtagctgccgcctactgacaacctccttgcctcgatgatttcccccccagacccttctctccgccagagccgtctgctgtctggttctcattgtgcctctcttcttccatggctccctgttgccacccacagcagcatttcctcagcctcggttatctgcacaccaccttcataagctttgccgtggtcattcccatctgtactgcgtttcttcaccttggctctccccccgaccttttgttctacgtatttaaaagaaatatttatagcactatcagtattacttgccctaaatagtactcataaaaagcctggacaacacagtgagaccttgtctctacaaataataaaacaattagccgggcgcggtggcccatgcctatggtcccagctactggagagggtgaggtgggaggttcactggagctcagcagtttgaggctgcagtgagctgagattgtgctactgcactccagcctgggtgacaagaaagtactcataaacacaagctgaaatttaaaaaagaaagctttcaacagtctagaacattctagttaagtgctctagtctctctgatcctgaagcctacacttttttcttttttgaggagtctcgctctgtcgcccaggcgagagtgcagtggcacgatcttggctcactgcaagctccacctcccgggttcataccattctcctgcctcagcctcccgagtatctgggactacaggcacctgccactacacctggctaatttttttttattttgtatttttagtgaagacagggtttcaccatgttagccaggatggtctccatctcctgacctcgtgatcaatccgcctcggcctcccaaagtgctgggattacaggcatgagccaccgtgcctagccctacaccttcttttttaaaagggttggtggggtgtcaaagttacagtagcaccaaactgagattttttctttttcttttttttttttttttgagacagggtctcactctgtcacccaggctggagtgcagtggcacaaacatggctcactacagccttaacctcctgagatcaaaggatcctctcacctcagcctcctgagtagctgggaccacaggtgcccaccaccatgcttggctgattttttaaaaatttacgtaggccaggcgcggtggctcacgcctgtaatcccagcactttgggaggctgaggcaggcggatcacctgaggctgggagttcgagaccagctgaccaacatggagaaatcctgtctctactaaaattacagaaaattagctgggtgtggtgtcgcatgcctgtaatcccagctactcgggaggccgaggcaggagaatcacttgaactcgggaggcggaggttgcagtgagccgagatcacaacattgcactccagcctgggcaacaagagcgaaacttcatctcaaaaacaagaaaaaaaaattgtgtaaagacaggctggacctgaactcctgaactcaagtgatcctcctgccttggcctcccaaagtgctgagattacaggcgtgagccaccgcacctggcactttttgatgtcttaaagactggaagaaaatggaaaaggaaataattttctgttattccatgccatgaccttgttttgcccccaatcatctcctgtgctgccagctggatgtgtcctacacttcagggcacactagcctcaggatcagttcccaatccttcctctcttccctctctctgtgctctaaatcatgaaaaccttctggccaatcctgacagatgccacatgtgctgttcttttcaacctagaatccccttcccccgtaccacctcctgaaaaactcctactcagccttcagtactcaagttttcaagtgccacacttcctctgggttggcttcctgttcccccatcagttgagttggctgctcactttcctcacagcactcagccatgtggtccttgggccaggaacgtctttaatcttatacctctcagtgagacagcgcctatcacacagtaagctcttgagtcaaactgtcgaaagcccaggaggaaaagccatttcctccaggaagccttctcttttctcgaaatgagaggttgctgccaggtgccgtggctcatccctgaaataccagcactttgggaggccaaagcaggaggattgcttgaggccaggagttcaagaccagcactgtctgtataagaataaaataaaataaaataaaataaaataacgggtctggccaggtgcagtggctcacacctgtaatcccagcattttgggaggctgaggtaggcagatcacttgagctcaggggttcgagaccagcctggccaacatggcgaaaccccatctctactaaaaatacaaaaattagccaggcgtggtggcaggcagctgtaatcctagctactcgggaggctgaggcaggagaattgcttgaacctgggaggcggaggttgcagtgagccaagatcatgccactgcactccaacctggcgacagagcaagactacatctcaaaaaaaaaaacaaaacaaaaaattaaccctgcattgtagcacatgcctgtaatcccagcagctactcaggaggctgagacacgagaatcacttgaacctgggaagcagagtgagctgagatcacaccactccactccagcctgggtgagagagtgagactttgtctcaaaaaaaaaaaaaaaaaaaagatgggtcacactacccacagcagcgtttccctaatctcctagcacttccctcctccaggactgtattgtaattatactgtggccactttctggaaagaaaggaggatgaccacaaaacctggcatttaagacacttagagctagttgctaattgactggccaggatgggcccctgggatggaggcaggagtgctggatgcccgcgtctcttcttacaggcctaaagatccctcctggctgtgagctggtggtcggcggtgagccccagtgctgggctgaggggcactgtctactggtggacgactcttttctacacacagtggctcacaatggtaacggggtgcccattctgcaggggggatgagggactcaggagcaaaggagcgttgactagaaggcagcagaatcaggcccaacggacttcctgtcctaccaccaccatcttccagctgcatgaccttgaacaagccgcataacttctccaatgccctaggaccaccaccttcttcatcaagtaactgcaaggattaaatgagataatattacgtacacagaaaagcggttaccagcacaggactctgggttcctgtcctacctcttgcacttgggcaaaggacttaacctccttatgcctctgttgctttgtataaaatagggataattatggtaataccacagtttgttttgatgattaagagttgatacatatcggccgggcatggtggctcacgcctgtaatcccagcactttgggaggctgaggtgggcggatcacctgaggccaggagttcgagaccagcctggccaacatggtgaaaccccgtctctattaaacatacaaagaaattacccaggtgtggtgatgagcacctgaaatcccagctactagggagactgaggcaggagaattgcttgaacctgggaggccaaggttgcagtgagccgaaattgcgccactgcactccagcctggtgacagagcaagactccatctcaggaaaaaaaaaaaaaaaaaaaaaaaagatttgatacatttaaagggttagaacaaggcctgccacttatttactgtttgcttttatggtgtttggtgagtgctctggtgtgcaagtacctaatgtcagtggctctgctgttcctgtcccatgtgccctaggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatggtagccaggacctcctctctactgcgggggtgggcgggggcggaggatgggaactggctagtgagcactgaaatataaattctgaatcctctcctaactcccgactacttccttcgcagggagaggctggggcagggccttatgtcttctcctagtacaaccaaacaggtacctccttttttttctttcttttttttttttttttgtagagtcagggtcttgctttgttgcccaggctggtcttgaactcctgggctcaagtgatccttctgcctcaacctcctgagtagttgggattacacgtgtgagccaccacgcccggccagatacctcctaacacaggcatctccccgtccctctccccaggagccagcaccagtttctcaacttaactttatttcaataatttaatagaaaattaaaataataaataatatgaaacagactgataacgctgagctgggcaggcccaggccagtctagtacaaagttaaggaggtagggaggatggtggggaggagggggcggactaccctgcaggacgcgggaggctgctcagactgtggtgatgtcaggaagggccgcacactttggcatggacgatgcactaaaaaaagagaaagggaattctaaatccctcttaaccagctggagagggaaggacgcagggccagggtggggacaagtgttggcttcggaaggctctgagtggtggggccggaatgtaccatgttgttagcaatggggttgggatgggtggagaagggccaaagtgagctgtgccatgcaatgaagggacagaggaggacccacgacttggccagcagagccggggcaaaagtctgggaaggggagggaaagagagagggactgggtcccaaggcaagaggaaggcagggggagggtcagaggtcagtccttgaagacaatttgttggccatgaggacgctcgtcgtgggtgatatggcgccggacatggatcctgcggacacggtgctctcggttctcttcatcctccccgcggccagccccaccagctccagctgctccccctgtggcctccaggagggctgggtctgggccccggggagtctcgtagatgaggatgttcagggtctcctcgaagatccgggcctctggaaattccacctgcaaaaggccagccggccccagctccttccttctggtgcagtcacgcagggccatccccctgcctagggcccctgcaccaacacacctcctagccctgcagtcaggtccttgggcctggcctggcctctctgccactcctttactcagcaaagtcatacttcaaggctcagctctgaagtcaggcaggcagaattatttgttttctctccttcatctccttccctgcctagcctcttggtatattttttcatttgacaaatactgagtgagtgcactgcaccaggtattgttctaggcactgcaaaaatagcagtgaacaaaacaagagttctgtcctcaggaggttacattctagtgggaggactcagtcatacacttaagaaaatataaactagcctggcgcagtgactcaggcctgtaatcccagcactttgggaggccaaggtgggaggacagcttgaggccaggagtttgagtctagtctgggcaacatggtgtaaccccatctctaccaaaaatacaaaaaattagctaggtgtggtggcccacacctgtgttcccagctactcgggagactgaggtgggaggatcacctgagcatgggaggtggaggttgcagtgagccaagattgtaccactgcactccaacctgggtgacagtgagaccccatctcaaaataaataaataaataaataaaataaaatataaatgcagtcaaatgatgatgtttaggaaacgatataagctgggtgtggtgtctcctgactgtaatcccagcacattgggaggctaaggcaggaacatcgttagagcccaggagttcaagttcaaagccagcctgggcaatgtagcaagacctcatctattaaaaaaaaaaaaagagagagagagagaaagagatacatcaggaaaagagatacatcaggaaaaggggatgtgatagccagagccaggagtgttacaactttaagaaggactccagggaaggcctcactgagaaggtgatatttgaccaaaggagtgggggaggggacaaggcacacagagcagaaagagcagcctggggagggccagggccagcgtgagagctgtgggtcaggagtgcacccagtgtcttactggaagatcaaaagggaggccaatgcaattgaggcagagatgagagggaatggaaagggatgaagtcgaagaggtgactggggtgttcccttgtgtggccttggaagcatctaacacagctcttagcaaactgtttttttaattttttatttttattttttattttttcctgagacagagtcttgctctgtcacccaggctggagcgcaatggcacaatctcagctcactgcaacctccacttcccaagttcaagcgattttcctgcttcaacctcccggagtagctgggattacaggcatgtgccattatgcccagctaatttttggatttttagtagagacagggtttcaccatgttgtacaggctggtctcgaactcctgacctcgtgatctgcccgcctcagcctcccaaagtgctgggattacaggtgtgagccaccatgcccggccttttttttttttttttaatcgttgtttgtttgtttctaagacaagatctcactctgttgcctaggctggagtgcagtggtgtgatcatgtatccctgcagcctcaacctcccgggctcaagtgatcctcccacctcagcttcctgagtacctgggtgtaccactatgtccagttaatttttttttattttttgtagagatggggtcttgctgtgttgcccaggctggcctcaaactcctggccttaatggtcccctgcctcagcctcctaaagtattgggattacaggtgtgagccatgcactctaattattggtttatcttcctatcttcccaatcagaggatgtttcttggaagctgggtcactgattcattcattcattcattcaataaatgtttcctagcttccactgtgtgaaaagggcccagctaatgggagataggaaagaaaaagacatggccctgccctcaaggaactaacacctcgctgctgatgcaaaccccctcccctccaccacacatgataaaacactgtctttagctatgaagggagtgtgaccaactttggggttgctggattgaaagttcatgagtgaaggtgacccaaagaaagtgatgcttagcttgagtcttaagattaagtacaagttcattaggcagatagaaggaaagaattccaagaggcaacagtgtgtgcagaggtaagaggtaagaaatagcactgagtgcttagagacttgtgatgactgtggtgtacctgaggcatgtggctcatagtaagctcggaagggaccagatgaggaagggcttgtattttgctcagcacttcattccccttgatttccagcccggtacagtacttagcacagagcaggggcttggggaatatcttgatgattgccacattaatgactcaggatctacaaactcagaggatgttctaagagacatctgattctgaggttttaagaatctatttttggcaatgggcctttctgagtttcccttttttttttttttaattagagttagggctcactctgtctcctaggatggagtgcagtggcatgatcatagctccctgctgcctcaaattcctgggctagggcgggcccggtggctcacacctataatccaagcactttgggaggccgaggagggcagatcacttgaggtcaggggttcaataccagcctgaccaacatggcgaagtctctactaaagagacttctctactacatttagtctctactaaaaaatacaaaaattagccgggcatggaggcgggtgcctgtagtgccagctacttgggaggctgaggcaggagaatcacttgaatctgggaggcagaggttaagtgagctgagatcacaccattgcactgcagcttgggcaacagagtgagactctgtctaaaaaaaaaaaaaaaaaaataggctgggggcagtggctcacgcttgtaatcccagcactttgggaggctgaggtgggtggatcacgaggtcaagagattgagaccatcctggccaacatggtgaaaccccgtttctactaaaaatacaaaaattagctgggcatggtggcacgtgcctgtagtcctagctactggggaggctgaggcagaagaatcgcttgaacctgggaggtagaggttgcggtgagcggagattgtgccactgcactacagcctggtgacacaacgagactccatctcaaataataataataataataataaataaataaattactgggctcaagcaatcctcctgccttagcttcctgagtagctgggattacaggtgcatgccatcatgtcaccaagccaccacacctggctaaattttttgacttcttacagagatcaggtcccacgatgttgcccaggctggtctcgaactcctgggctcaagtgatcctcctgccttggcctcccagagtcctggggttacaggcgtaagccactatgcctcaccccttctgagtttctaatggcaactatggaccccctatacagaaaaatgcatacacccccatttcaggagttgcaaacagccttgaaacccatccaacaggcctaggctaagcaccctgctctaacccgtgacccccatttcacagagaaacagagacccacagggatagggtggcttgcccactgttgtgcaccccagaccccaggatctggctcctgcctcctggtggtgggctccttcccctgccaacctgcttttgtccagggtcctggtcctggccacccccagcccccaacataggctctggagcccctctgaccttggtctgcttcttctccgtagcatagacaatggaggtgcagcacacctcggcgattttgcggccctgcccgtagaaagaccagcagcagatctcgtcccccaggacatccttgaggaagagtagccgcccgtggaagcgcagggccagcttgtcgaacagctcgatgttcttaagtaggttgtcatctgaagtgctggggaccaggggaccaggaggcctcagcgcagttggcacccctccctctgtacccccagaagacgggcctggatgcattcccagtcctctgctcctgcccagggctttggtgctcaacagagagcctcctccacccctggggccaggctaaacgggtctcagaagggaagccacatgcgctgagcaaatcccagcacagcacagcacagcagctccagtgagggaccgggagccaggccacctccccgggggtcctggtgtccccattttttaactgggtgacactaggcaagttacttcacctcttggtgtcccgacctcctcatctgtaaaatggagctcacaacagtactgacctcaagggggaggactctgccagttcctagaatgagagcacttgggataggctcgccactatcactttgtcctcacccaaacccatttactgatgactgagctgaagctgagaagcagaaaggacctgcctagagcgtcaggggtaagaggcgaagccgaatctgcgagcaggcacagatgttcttgtaggccccccgtgtggccgtggccctcgccttgggcagaagcagggctgtgctgcatcccagggtcccgcccagtgccccgcaccccggcggtcacctggtgtaggagtacttgttgttactgcggttgtgcaggagcttcaccacgggctggcgggggagagaggatggacgagaggggtgaggctgcagggagaggcccccccagtgagcctccaccctgcagggcttgggggcctcaccttggaggtgctggccaggagctgctgctcctcccggggagatgtcaccatggggatgaggcacagcggggacagcgtctcccttttttgctggggaagaagcggaaggtggttaacagcacaaccaaaggccacgtactcccccacttaaaagccttcaaaagctggttgggaacaactccagactcctcagtggtccgcagggctctgcaggctccaagctccgccagcctctctgccactctccctttgcttgctgggccttggtcccacggacaccttgctgcttcacacatccagcttgtgcctgccccggccactggctgtgcccctgcccgggatgcttctttgctcagctgtcagcgtggcgtgtccgtcatgccattcagatcgcaggtcacacagtgcctcctcagggccagccctccccagcccccctggctaaaacagcctcctctacatcctgccttttgtgttatcagttttctttttctttttttgagacagagtttcgcttgttgcccaggctggagtgcaatggcgccatctcggctcactgcaacctccacctcccgggttaaagcaattctcctgcctcagcctcctgagtagctgggattacaggcatgtgccaccacacccagctaattttgtatttttagtagagacgaggtttctccatgttggtcaggctggtcatgaactcccgaactcaggtgatcagcccgcctcagcctcccaaagtgctgggattacaggcgtgagccactgcaccaggcctatcagttcattttctacacagcagttagtgtctgactttttctaactttttgtatttgtttatgatctgtctcttcccacctaggaataactacctagtatacagctgatgctctgtatttgttgaatgaatgaacatatttgttgagtgaatgaacttcattgggtgggatgacgttggagaaagaaatctgaagcaaacccatgggcttctttctcttctgtcttctagaatcttcatgccaaaatccctctcacttctcccaaccttgaaaactcaatgcgcaattctaatacaaattccagatttgttttttgcagaaactcataagactctctaaaattaacagagaataataaaagtctacaattactgaggccattttttttttttttttttttttgagacagggtcttgctgtcatccaggctgagtgcagtggcatgaccacagcttacagcagccttgacctcctgggctcaagccatcctcccaaacttaggtcagtttttaaaaataagagcaaagaggaaaggccgaccctgccagatattaagataggctgcaaagccacaacagtgagaacggtatcagttcgggcacagaaacaaaaatacctgagaaacacaacagagcgatcagaaacagaccactgtgtatatgagaattggtatttttaaaaagacaccacaaatgtgcgaggggaattacggagtatgaattcgttatctatcactgtgtaacaaactgcccccaatttaggagcttaaattaacaatatttattacttctgtttctgagggtcaggatctcagcagtggctcggctgggtggctccggcacagggtctcttctgaggctgtggccaagatgtcagtggggctgtgggcatcaaaggcatgaccgcccctagaggatgcactctgagaaagcttgttcatgtggctggcaagttcgcactagctgctggcaggaaacaacaaatccctgccatgtagatctctccacagggttgcttgagtatcctcgcagcatggcaactggcttctccagagcaaataattccagagagggcaaggtggaagcctcattgtcttttttatttttgagatggagtctcactgtgtcgcccaggctggagtgcagtggcgtaatatcggctcactgcaacctccgcctcccaggttcaagtgattttcctgcctcaaccacccaagtagctgggattaccgaggtgtgccatcacgcccagctaatttttgtatttttagtagagacagggtttcaccatgttggccaggctggtctcaaactcccgacctcaggtgatccactcgcctcagcctcccaaagtgctgggattacagacgtgagccacagcgccgggcccctccattgtcttttatgacctaggtctgttggtcctatccagtgaggaaggagatgacacacaggaacgagcaccaggggacgagaatcatcaggctgccttggtggctggctccacaggccaccgctggctctcagtgatttcccccctcccacatgccaaatatactcaccaccttccaggatcccccatcatcccattacagcatcagctcaaagtacagaatctcatcatctcagtcaggtccaggtggggatgtggctctagcatgcagttccgtaactatggctccttaagtgcatttcttttttttttttttttttgaaatggagtcttgctctgtctcccaagctgaagtgcagagccaccaccatctcacctcactgaaaactctgcttcccaggttcaagtgattctcttgcctcagcatcccaagtagctgggactacaggcatgcaccaccatcccagctaattttctttagtagagacgggatttcaccatgttggccaggctcgtctttaactcctgacctcaggtgatccacttgccttggcctcccaaagtgttgggattacaggcgtgagccaccgcatccagcccttaagtgcatttcctatctgcagacctgtgagctaaagagacaggtcatctccacactcccagtgtgcagtggtagaggcaggcacaggataaccagtaaggacattcttgctcaaaagcaggggaagccgggcgtggtagcgtgtgcctgtcatcccagctactcaggaggccaaggtgggaggattacttgagcccaggagttcgagaccagcctgggcaacatagcaagactctgtctcaaaaaaaaaaaaaagtggggcaggggacaggaggcacatataagtcatacatataagtcactggtgtgtggaaattctgtaatccagttggagaaatgctaggaactctttgatgcctactcctgttcatgaatgattctccatggctctccctgagtcgtcccacctcttccatgaaagatgtttgcagctccacagtttcatctgcctgcttcctgcctgtaaaagtttgggtgtgcaaagccgtcttgtccttttgcactggctctgtccctttcagtccaagctggcagtgtctctgccaatataattctcttcataacttattgggtatcttgcatgtcttagggttcactacattagaaaaaagccacacctagaaatctctgcaagtggccaggcacagtggctcacgcctgtaatcccagcactttgggaggccgaggtgggtggatcacctgaggtcaggagtttgagactagcctgaccaacatggtgaaaccccatctctactaaaaatacaaaaattagctgggcgtggtggtgggcacctgtaatcgcagctactcaggaggctgagacaggagaatcacttgaacccaggaggaggaggttgcagtgagctatctcaaaaaaaaaaaaaagaaaagaaaaagaaaaaagaaaatctctgcaaggtaagcccttctctactttgggcttgtgctgagacgctgaaagacaacacctttaaccttctcagaagcgtgattattatttcattcgactggaagtcccctctgaggcatcttgttggtatttctgaggtcttaacaaaggactttttcatcacatcctcagcttgacctttagaccacatttccctgtatttaatgccttgtatttaatctttgcacggaagccatttgttaattttaacatcacttgttatctggaaaggctgggaattttcaaacccaacaatttcaggctctttttcatttaagtgttttttttctttaacttactctctcctcttcagttttactataagcagcaagaagccaggtggcaccttcaacattctgtctggaaagctccttagctagaccatccgttccttaggtatatttcctaccctccacactaatgcaggagacagtgttgctaaactttctgccgctacacaaggatctcctttccatcagtttccaatagcattttcctaactgttcttcaagcccttattgcagctgtcttaaaggtcactggactcttattaacagactttctcaccttttttcttttaatttttttagagacaaggtctcactatattgctcaggctggtctcgaactcctgaactcaagtgatcctcccaccttggcctccaaaagttatggtattacaagtgtgaaccactgtgcccagccaatactttttaacactccttaagcttttactaacaatctcctcaaagtccttccagcttcttcccacttctcagttgtaaagttacttctacatttgaggtttctgttatggcagacccccattccagaaaccaaagtctgttctctgttactgggtaacaaattactacaaactcagcagcttaaaacaacagtccaggtgtggaggctcatgcctgtaatctcagcattttgggaggccaaggctggaggactgcttgaggtcaggagttcgagaccagcctggccgacagagcaagactctgtctctatttaaaaataaataaataaaaataaacattatctcacatagtttctgtgggtcaggaatttgggatgggcttagctgggtggccctggcccagaatctgtcatgaagctgcagtctggattttggctagggctgcagtcatcagaaggtttgcctgggcctagaagctctggttctgagacaggtcaccactatggcggggagtctgtgcttgctgtcggcaggggcttcagttcctcaccaagtggacctctgcttagggatgcctgagtgtcctcacatagcattcacatagagtgagtgatctcaaagagaggcagaagctgtaatgtcttttatgacctagcttcaaagtcacatgctgtcatttctgcaatgtcctattggtcatacacaagggtctccttggtgaggatctgaaaaggtctgccctatttggtgtgggaggggactgaacaagagcctggaaaccaggaggcaagaacccctggtggctgtcttgggtgctggctacctctggactgtttaatacctggcactgggaaaactacctcaccctatggaagacaaaaatgagctaaatcccttcacaatcatatttacaaaagtgagttccatttagattaaaatacccatatatgaaaaaaatccatatttaaaactataggtcaggtatagcggatcacacctgtaatcccagcactttgggaggccgaagtgggcagatcgcttgagctcaggagtttgagaccagcttgaccaacatggcaaaaccccctttctacaaaaaatacaaaaattagacgggtgtggtggctcatgcttgtaatcccagcactttgggagaccaaggcgggcggatcacgaggtcaggagttcgagaccagtctggccaacgtcgtgaaaccccatctctgctaaaatacaaaaattagccaggcatggtggtgcacgcctgtaatcccagctactcaggaggttagggcaggagaatcgcttgaacccgggaggcagaggttgcagtgagccgagatcatgccactgcactccagtctgggcaatagagtgagactccatttagaaaaataaaaaataaaaaatcagccaggtgtcatggtgcacgcctgtaatcgcagctactcgggaggctgagacatgaaaattgtttgaacctgggaggtggaggttgcagtgagccgagatgacaccattgaactctaacctgggtgacagatcaagactctgcctcaaaaaataaaaataaaactacaaagctcacaggtaacagaaaatcagaaaaacatttttaaacaagaccataaggatacagcattaggcaaaaaatggtgaggaattggactacatccaaatcaagaatttttcaagttgacaatggaaagcatgactttacaaataatctcatgtaataatgttgaagagaaaagacttataggtattctgtggcacaaatgtaattactggttcaggtaaggattatcaatttgtgtgtcattgataggtaactgccttaatacagtggccaaataccatatgcattattttatagttagcaacaaggaaatgtaacaatgatagagaaatcaaaccaccatcccctagatccaggggccaattatgaacgtcattaatgacgagtcatattaacaatattatgggttgcttgatgtggcccaacgtgaaatacatacataatattacctaaaatgtattctaaacaaaatgtttaatatcagtcattttatttattttattatttattcatttattttgagacagagtcttgctctgttgaccaggctggagtgcagtggtgcaaccttgactcactgcaacctctgcctcccaggttcatataattcttctgcctcagcctcctgagtaactgggactacaggcacccaccaccactcccagctaatttttgtaattttttatttatttatttatttatttttgagatggagtctcgcactgttgcccaggctggagtgcagtggcacgatctcggctcactgcaacctctgcctccccaggttcaagcgattctcctgcctcagcctcctgagtagctgggattacagatgcccaccaccaggcctggctaatttttttgtatttttagtagatacagggtttcaccatgttggccaggctggtcttgaactcctgaccttgtgatccacctgcctcagcctcccaaagtgctgggattacaggcatgagccaccgcacctggcataatttttgtatttttaatagagatggggtttcaccatgctgaccaggctggtctcaaactcctgacctcaagtgatccacctgccttggcctcccaaagtgctgggattataggcgtgagccaccgtgcccacccaatatcagtcatttaaaatctacagtctggtttacaggaaattaaggataaggctgggtaataaaccaaacgataccgggagtaaacaaccaggcaaagttggaaagcgggtcattgtgcaggacaactggcagtctctttaacaagccagcatcgtgaggaaaaagggaccccttggattgtaataaagtaatgcttatggtattatttggcttatgtaataaagtaatgcttatggtattatttggcttatgtaataaagtaatgcttatggtattattatggtaactgtattaaggcagttacctatcaatgataatccttacctgaaccagtaattacattcgtgccatagaatacctataactcttatcatctcttcaacattattacatgaaactatttgtaaagtcatgctttccattgttaacttgcagataaccagatgcaacgtgaagatctagactggaccctggtttgatgaaccagctgtaaaaacacatttctggaacaactggagaaaccggagtatgccctggactggatattaaataaaaatttattgacatgtaaagatggcaattattaacaacaacaaaaaacagattataaaacatttcatacaacacgattgtattttggcaagcaaatacacacacacacacatactctcacacaggaaacgacctggaagaatatttggtgcttttattttttagattatttgtgtttctgaaatttctacaattaataaatactgctttaaaataatcaatggttatttgtaattttaaaaaatcaaggatttccattcaatgctagatgccacaagtgggtgacattctaagaaaaaatattggcgatatctacattgactagaaatttttatctagaacagactttttcaactgaagttcctcatctgaatctcaaaaaccagcaaatatggccaggcacggtggctcacgcctgaatcccagcactttgggaggccaaggcaggtggatcacttgaggtcaggagttcgagaccagcctggccaacatggcgaaactccatctctaccaaaaatatgataaaattagccaggcattgtagtgcacacatgtagtcccagctacccggaaagctgaggcaggagaatcacttgaaccccagagagggaggttgcagtgaggtaagatcgcgccactgcactccaccctgggcgacagagcaagactccacctcaaaaaaagaaaaacaaaaacaaaaacaaaaaaacagcaaataatttgagtgttttctgaactttgctgagaacagtaggtaaatagtcccatgctacaggcttagaggttaatttgttatgtatataatccatgccctagggaatgtataagacatacccatatgcagtagggcttaattatccctaggaactaaactaaaatatgcaaggatctcctgctaagcaacatgaaaaagaaaaaagcagaaaatctggtaaagaacatgaataagcaattcacaggaagggaaacaaaaaaacactagtgagtatatgaaaagatgctgaacctcattagtaatcagaggcatgcaaatgaaaatgagatcacgctacactcattggattggcaaaattagaaagctggatgatgccatgtcttgatgaggacatgcagaaatgtaatctcttatgcactgctcattatgaggataaagtattataaccattcgggagagcaattagatgatatttactaaaacgccgtttgcaggtgtcctgttatccagcaattctactcccagctacaatgacaggagactggcacagaatcagaagggagcatgtaccaggatgctcatggtgacacggtttgtaggggcaggaactggaaggcaatctaggtctccaacctcaggggaatgtatgaacaaaatatggtgaatgaacaccgcagatttctctgcagctgttagaagcaaagaactagatgtacttggagcagcatgaatagatcttgaaaaaaagtgctgaattaaaaaaacacaatgcaacagaaactgattcacagcttcaatgccatttatggacatttaaaatgcacacatatgcagaacaatgctttagcttttcgagcatatgtatcaaaacattaaaattggatgggtgcccctgggaaaaaggaaagtaggcaggggactgggaatgaagggaaagaaataaaactaaaagacaaaaggtttgcatagaccaatattgatgaagtgccacacactgaggagtgtgctgagctgcgtgaggtgcagagggaacctggaaaggagagagcaggagtatagaaaagtacagctcttgggaggctgaaggtcagatagtcaggtagcctggggtcaaatctgagctctgctgcttcccagctctttcaccttggacacgtcttccaagctccctcgcgtttctttttacgtcaaacaaggatacaagatgtatacacaagcagatagcagaattgctcctgacacacagtgggtacatgatgacattagtaaatttaaaactacaggccgggttttaaaactttagttttaacattagtaaatttaaaactacaggccggtggctcacgcctgtaatcccagcactttggggggccaaggcggatggatcacgtgaggtcaggagttcgacaccagcctaacaaacatggtgaaaccccgtctctactaaaaatacaaaaaagtagcaaagcgtggtagcaggcgcctgtaattctagctacttgggaggctgaggcaggagaattgcttgaacctgggaggcagaggttgcggtgagccaagatcacgccattgcactccagcctgggcgacagagagactctgtctcaaaacaaaacaaaaatgctacagagcaggaatgcacttccaagatctagtacaatgaatgtttctcaaatgcaagtggtaatttattaatgggtcatgaaataagtaatgggtcccaaacagcattaaaaagaaagattatcagagtacatttcactaaaagtatctttttatagaactgttatttcagttatatataatgagtactaaaatgcattttttccctatggcaggcaatcaaaaagtttgaaaaacatggatattgtccaaaggagttctacacctttgggcttcaagaaccagtaagtattccctgagacaaaagttgttcagggaggcaaccttttaatctataaagggcattcaaaaagaaacttttataatcttctcttactattgtaacataaaagaaaggacatttttaacattgtaaaaatagaacagaataacaggctttatgtaaaactcactactttgtacttatttttctcccttccctgtctttcggaacccgaggacagaatcccagaggtaggaatggactcactgaaggtcactgagtcagctgtgacagaggtgacacagaacccttatgtcctggcttcactttccaagctctgctcctcagaaccctaaggggtccacaaaagtggagcctagcaggtggggtctctagaatccccaaccctgttttactgggagtggccctgcttctgtgagatttcatttgaataaagaatttcactgtttaaaaaaaaaaaagaattagaaagctcctggggggcggaagccatgggagaatgctgcctcccaggatagggccagatcgcagaggttattatatttcaatttaaatttagatgtttttccctagtgacatgagggagctatttaggatttctaagcaagagagagaatagatcggggttgtgctgaaagataattactcaggtgcgagtgtaacagctggactggctgcataggaacagtgggaagtagagagcagctatttaaccattgcaaaggtcctggcatgaggctggggtgggggtgctgcctgaggcggcagggatgcagaagatggcacctcaaattctctggggttatggccagccaaagccaggctctccaagccataccccatatctccttttttctgctctaatacctgcttgggcagctctcccaggaacataggcatggggactccgaaggccctcacctgcagcgccagctggcagtcctcaatcaggccctgcaccaggtagtagcgtgcttcgcccagcagctcccccagttctctcgtactctccggcagtggcacagacccatcccgcaggtaattgaggattgtaccaaagtgacggccgctccggtcaatcagcacccaacctagtggggtggggagaggcagggggaaagatggctttgctgcgggacctggagctactaaattaaaaaaaaatttttgtagagatggagtctcactatgttgcccaggctggtcttgaactcctgggctcaagtgatcctcccatctcggcctcccaagtacttggattataggtgtgagccaccaaacctggcctaaattataagaaaaaaggattccagccaggcgcggtggctcatgcctataatcccagcaccttaggaggctgaggcaggcagatcacctgaggtcaggagtttgagactagcaggaccaacacggagaaaccccatctctactaaaaatacaaaattagctgggcttggtggctggtgccagctactcgggggggggcgaggcaggagaatcgcttgaagccgggaggtggagtttgcagtgagccgagatcgcgccattgcactccagcctgggtaataagagggaaactccgtctcaaaacaaaaaaataaaaaaagaaaagtaaagaaaagaaggccgggcacggtgactgacgcctgtaatcccagcactttgggaggccgaggtgggcggatcacctgaggtcaagagttcgagaccagcctgaccaacatggagaaatcccgtctttactaaaaacacaaaattagccgggcatggtggcgcatgcctgtaatcccagctactcaggaggctgaggcaggagaattgcttgaatccgggaggtgggggttgcggtgagccgagatcgtgccattgcactccagcctgggcaacaagagtgaaactccatctcaaaaaaaaagaaaagaaaagaaaagaaaagaaaaaggattccaaagccacaaaaaagtctgaatactgatctgtctcaaacctgtgccacagccaagaaatctctttaaaacatctccagcgagttctcccttaagtttttatacatattcaaccagataattaactcatccatatctggtctacagtcagaaggctctcaccatgagaaagttcttgcagaattaccttatcaataaactgttaacccccgaagttaattctcaccatcctatttaattaaaatgtctacctccccccgtccagttcactgccattttaacttttatattcttcatagagcttactatcaaaaaaagaaaaaagaaagaacttactactatctgcaattgcatatgcatatacattttgtttacttgcttattggtcttctgatctcccacttccctaaaaaaagggaatttccataattttgtcaggttcatttacctatctccagcactaactgatattttacaaatacttattggacaaatgaattcttcccttttttttttttttttttgagacagtctctctctgtcgcccaggctggagtgcagtggcgctgtctcggctcactgcaacctccgcctcccaggttcaagcgattctcctgtctcagcctcccgagtagctgggctacaggcgcacaccaccacgcccggctaatttttgtatttttagtagagacggggtttcgccatattggtcaggctggtctcgaactcctgacctcaggtgatccaccgcctcggcctcccaaagtgctgggattaaaggcgtgagccaccgcacctggccgaattcttcacctttgatacttgaaggcagatctccgcctctcaaatttttattctcctgctctcacagtcctcgttaacccctcccttaagactctcccactcccaaactccaaaacttcaaagtctcacttgggcacgaagggtccatacttgaatgcaacactccaagaaggtaaggttcacctgccaaggagacctgtccaccctccactctggtgtccctggcaaacccaaagcagcctccttctgcaatgtgtgtatacaggtggattcctagagtgtacagggacctgtgtcaggggaacacagaggcaaacaagatctcccagctctcctggctggctgtgagcagttctgaagcagagagggaaacaaaaggctgggcagtcggaagaaactgaggaaggctgccaggagtagtactgcaggcagcagggctagttcccaagtcttgagctgaggggtgaagggtgggagaggtggtcatgaggattatgaactgacacgttcaatcacttaccacagcgcctggcagttaggggttccgtaagtgttggttattgctgggggtaaaggattgggggaggagaagagaaattatgaatgagaaaggggaggagatgggatgtgggggctggagggagctgagaatgagttgactggacagtagcgggcagagagaaggggcatgaggagccccggtggtgagagactgcggggaacgggagttgggggtctggggtgggggcacggtaggggcgccgctcgtacctccggcatcggtcagcacctccacgcggccgctgaacatggctttgagcatggtgtcctgtcccgtgagggtgcgcagcgtggtgtagtgcaacgagccgcccacgttcagcttcacgtatttgctgttcggggtcagcggcttgagaccgtaggcggcggggccaggctcgagacccgagggcttgggggcttccagggacggggccgcggcggcagccgggcccgaggcctccgccgacatgccgggtagcagcggcggacggcgatcccaggatctctccgcgccctgcggcctgctcccgaagaccctcggccggcccccagcccttgggccagaccgctcggcgcacacgcccactcaccgcagctactctgcaagaccggccctccgccccatctcgctcgcaccacccggaagccggcgccgggcagctgcgcaggcgcggccccgcccctgaatgggggcggggctgcgagtatggagcatgcgcagtggcctcgctgggggatcccgtagaggtttggcgtgtggcctgcgggttccccgggcgggtcgacgtgcgctcctctctggtctcgagtcaccaggaccagatcgaggatgcggccgaccccctgcccgatgtggaaagcgaagtctccacctcgtgattgggtctctgctgtcagagagcttcacgagcttgaggggaaacagacagagaggtctgggcattgggcagtttcccgcctcccagccccgcgcactgaacagactgtgaccagaactgcgaacaaagcgcggagggaagctcttaaaggaggccaaagcggccgggcgctgtggctcacacctgtaaccccagcctgtaagcctagctactcgggaggccgaggcagaaggagcgcttgaagccaggagttggaagctgcagtaatccgtgatcggaccgttgcactctagcctgggcaacataacgtcctttgaaaaaaaaaaaaaaaacagaggccaaaacgggtagcagtggtgcccgggcaccaaggatggaaggcctctctgaggaggtgatgccgagctgaagctgggaagcggatgtgagggaagagttccaggcagagggaaggcaaatgcagagatcctcaggcaggaacactgaactgttctccgtatttgaggagcagagggcgtgtcagtggtggccgcagcagctgagcaaaggtcttagaatcccagctaatgtcgtgggacctagcacccaatcccaaaagaaagaagaatagataggaacccactgttgacaagaaggtgcactgagaagtgtttttatctgacccgatctgcatccagtttagaagccgatacatcagggatttaacaatctgtcttaatgtctagcaaggggggttgctggagggaaaacacagagtcagagttctatcttcagccctgccagcaggtccctgggagatgctagacgagtgacttttctctgggcgtggttggtgtaagggatgcacacgcaggaggaaggtcggagtgtaaatgtgtgacctgggcctgttactgggtataaatgggcctgtagtgaccgggagctcatgttctaccaaaggggttgccaattttctgatttcgagtgtggcggtgtaaaagagaaaagcaactgctgccagctgggagctggtttgcaccctcactccagaagccttgatgttgctaggagctgacctggcaccaacagcacggccatggtggtgtcctgttgagcaaaataatttcacaaaaaacatcagacaaggtcactctctgactgatctagaaaaagaccattccataataaagcctcaatacagaaacaagaacattgtccaaaccacaaaaattaccaacacaatcctctctcccacagcgtaagttactgctgctttttttttggttgttgtttttgtttgttttgttttgtttttgaaatgaagtcttgctctgttacccaggctggagtgcagtgatgcaatcttggcttaccacaacctccacctccaggttcaagcgattctcctgcctcagcttccagagtatctgggattacaggcacccaccatcatgcccagatcatttctgtatttttagtagagacggggattcaccaagttgcccaggtgagtcttgaactcttgacctccggtgatatgcccaccttggcctcccaaagtgctgggactacaggtgtgagccactgcacctggccactgctgcttctttaccaagtacagttttagcttgattcattcctcccatcttctagataagaattattaagataaccaaaaagaattatccctacttcctgatagcatccaacccagagcaaatgcccccctttttggacccgcctaggaagtcccctaatgaaagttccaatcctgtaataagtcctttcacacatgttcttgctgagatgtctgtggtgttcagcctcccttgttcaactacaggtgcttcctggtggtccttggttggagggtactatcagaaatggaggagcaacaaagattcagctgaagccctcactgcctgggactgggacccttgactcgtcattgtatgcacacctgaaactgcttatgtcgctgaggtgccaacctgctgatggttggaagctaattgagttctgatattgtgttgatacccttaagcattgggtttactttttattttaattaattaattaattaatttttgagacagagtttcactcttgttgcccaggctgaagtgcaatgacacgatctcggctcaccgcaacctccgcctcctgggttcaagcagttcttctgcctcagcctcttgagtagctgggattacaggcatgcaccaccacacctggctaattttatatttgtagtagagacagtttctccatgtttgtcaggctggtctcaaactcctgacctcaggtgatccacccgcctcggcctcccaaagtgctaggattacaggcgtgagccaccatgcctggccatattttttatttttcattttttactttttgagatagggtctcactctgttgaccaggctggagtgcagtggtacgactcagctcactgcaacctctgcttcccagctcaagtgattctccagtttcagcctcctgagtagctggcactaaaattaaccaatgccggttaatttttttttttttttttggcgggggacagagtctcgctctgtctcccagagtggagtgcagtggcgctatctctgctccctgcaagctctgcctcccgggttcaagcaattctcctgcctcagccttctgagtagctagggttacaggcatgcgccaccacacctggctaagttttgtatttttagcaaagatggggtttctccatgttggtcaggctggtctcaaactcctgaccccatgatctgctcaccttggcctcccaaagttctgggattacaggcatgagccaccacacccaggaatgccggttaagttttatatatatatttttttgtagagatagggtttcactctgttacccaggctggtctcaaactcctgagctcaaagcaatcctcccaccttggcttcccaaagtgctgggattatagatgtgagccaccatgccctgccaagcattgggtttatttggtttttcagtttttttactcctggaataaggcccccacactggatttttggttatctgatcaaatatttattttgtccttggtgcaattgttttctgtccttctacactcattcctatggtgttttcttgtctagtattttgaatattgtttgtctataagaggcaaagtcgatataaaaaggatggatgtaggctgggcgcggtggctcaggcctgtaatcccagcaactttgggaggctgaggtgggtggatcacctgagatcaggagttcaagaccagcctggccaaaatggtgaaaccccgactactaaaaatgcaaaaaattagctgggtgtggtggcaggtgcctgtaatcccagctacttgggaggccaaggcaggagaatcgcttgaacttgggaggcagaggttgcagtgagccgagttcgtgccatggcactccagcctgggcgacagagaaaaaaaaaaaaaagtctctgtctcaaaaaaaaaaaaaaaagaaaagaaaaggatggatgtgtagcctcggatgtctaagggcatcacaaacctattattgctgaatctctggtgaccgaacacaacttatccctctaggaaggtagggatgccaactgttgaggggttgtgcaactagttagcatccgagagtcttatttgttatcagaattaaccagagaaatcactccagcaaccaagagccagtaagtgtgtcctacaaccagctccagagactgtacaattcggaaggtattctcagactaatgtcctttgggtaaactttgcccaggtcaccatttcttttttgtttttgttttttgagacagagttttactcttgttgcctgctgaagtgcaataggacaatctcagctcagctgcaacctccacttcccgggttcaagtgattctcatgcctcagcctcctgagtagctgggattacaggtgcctgctaccatgtccggctaatttttgtatttttgatagagacagggtttcaccatgttggccaggttagtctcgaactcctgacctcaggtgatccacccacctctggctcccaaagtgttgggattacaggcatgagccaccacgcccagccccaggtcaccatttcaaagccttgaaaaggatttctttggttttgtctatgtccttgcaaactgctttgtttcatttcttctgctcagtatcagggggctttctctggcctctgatcagcgatggtgtttggccacattctagagatacgaagttgtataagcaccattcttttagaccccagtcacaactaaaattgggccaaagacctgctcccttcatgttttctcacgattgcaataacatgtacccatatatctgtaactgacacaatttcaccagggacagtttgtaattgccgtagccatttggtggaacttttgataataacaagattgttcatttgggaggtgcctcagaacacaaagggaagaaacctttgtgagattgtttgccttgtttgttaaaaacaaagattattttgtttaacataggcaatatttcatttacctattttgcatattaataaatgctgtcggccaggcacagtggctgacacctgtaatcccagcactttgggaggctgaggcgggcgaatcacttgaggtcaggagtttgagaccagcctggccaacatggtgaaaccccgtctctactaaatatacaaaaatcagccaggcttggtggtgcgcacctgtaatcccagctactttggaggctgaagcaggagaattgtttgagtccatgaagtggaggctacagtgaactgagatcatgccattgtactccagcctgggcaacaagagcaaaactccatctaaaaaaaaaagaaggccctcaccagatgtggctgcttgactttggaattcccaccctccagaactgtaagaaataaatttttaaaaataaagtacccagcccctcaggtattctattgcaacacagaatggactaagacagtgtttatatgtcaaaatctattttcctgtgtttaaactgtcttccttctccttgcagagggaatataaccttagccttttggagtgataatttcatgtttgtctgaagtagcttcttctcacattttctttttttttttttttatgttcaaaatgcttttatttctaggaatttagttttatttttaattttttaattattatactttaagttttagggtacatttgcacaacgtgcaggtttgttacatatgtatacatgtgccatgttggtgtgctgcacccattaactcgtcatttagcattaggtatatctcctaatgctatccctcccccctccccccaccccacaacagtccccggtgtgtaatgttcctctttctgtgtccatgtgttctcattgttcaattcccacctatgagtgagaacatgtggtgtttggttttttgtccttgccatagtttgctgagaatgatggtttccagcttcatccatgtctctacgaaggacatgaattcatcaatttttatggctgcatagtattccatggtgtatatgtgccacattttcttaatccagtctatcattgttggacatttggcttggttccaagtctttgctattgtgaatggtgccacaataaacatatgtgtgcatgtgtctttatagcagcatgatttataatcctttgggtatatacccagtaatggaatggccgggtcaaatggtatttctaattctagatcactgaggaatcgccacaccagcttccacaatggttgaagtagtttacagtcccaccaacagtgtaaaagtgttcctatttctccacatcctctccagcacctgttgtttcctgactttttaatgatcgccattctaactggtgtgagatggtatctcattgtcttctcacactttcctgctgtccatttcattctctttttcctcacctctcttggaaagctttaaagattaactaatcaaaaaatttttcagttgtatgtgcacagtctaggtaaatccagtcctaaaagaaatagaaatgcctaaaatgctaaaagaaacagaaaatcatatatatatacgtatatacatgtatatcaagatcagcttgggtaacatgtgagaccctgtctatacaaaaaaaaatacatgtatatacgtatatatatatagtgtctgtacatataggcactaaaaagtatatttatgtaatagcctttgctcttccagttagaagaaaagatctatcacgcctgtagtcccagcactttgggaggccgaggagggcggatcacgaggtcaggagatcgagaccatcctggctaacacggggaaaccccgtctctactaaaaaaaatacaaaaaaattagccaggcatggtggcgggtgcctgtaatcccggctactcaggaggctgaggcaggagaatcgcttgaacccaggaggtggaggttgctgtgagccgagattttgccactgcactgcagcctgggcaacaagagcaaaaactccatttcaaaaaaaaaaaaaaggtcttagttccaagacaaaagaagagcttttggcatgattcagttaaattttttattcactcatgtaaaaatgatgccagcgtgatattttggtttgtacaagaacagggttaattctctttctctctctctctctctctgagacagggtcccactctgtcaccccatctggactgcagtggcatgatcatggttcactgcagcctcaaccttctgggctcaagagatcctcctctctcagcctcccaagtagctgggaccccaggcacacaccaccatgcccagccaattttttgttgttgttgtatagacagggtctcacatgttacccaggctgatcttgagctcctgggctcaagcagttctcccaccttggcctcccaaagtgttgtgattacagacatgaaccactcactgctcctggccctcatgatttaagccttctcaatgtatttatgttgatcttatgagttaagtaaattgtgatggttttcataaattgtttaaatgaaaattatacacaggcactccttgttttattacacctcactttattgctcttcacagatattgcatttcttacaaattgaagatgtgtggcaaccctgtgttgagcaagtgttttttgtttgtttgtttgtttgtttttgcagtggagtcttgctcaggaggctgaggcaggagaatcacttgaatccaggaggcagaggttacagtgagccaagatcgcatcactgcactccagcctgggcaacagagcgagactctgtctcaaaagaaaaaaaaaaactggaacagcctgattgctgatatggagaaagttttagtggcctgaatagatcaaaacagccacaacagctctaaatctcttcattactatgaagactgagagggattaggaagctgcaggagaaaaatttgaaggtagcagaggctagttcatgagatttaaggaaatgagccatctgcagaacataaaagtgcaagatgaagcagcaagtgctgtgtagaagctgcagcaagttatccagaagatctagtaagataattgatgaagatggtttactaaacaacagatttccaatgtagacagaacagccttctattggaagaagatgccatctaggaattttatagctagagaggagaagtcaaagctttgaaggacaggttgactctcttgtcagggactaatgcagctggtctggtgactttaagttgaagccaatgctcattaaccattttgaaagtcctagggccctgaggaattatgctaaatccattctgcctgtcccctattaatggaacaaaaaagcctgaatggccacatgtctgtttatagcatggttcatggaatattttaagcccactgttgagacctagtgctcagaaaaagagattcctttcaaaatattatgacagttcctctggtcatccaagagctctaatggagatgtacaaggaaattaatgctgttttcctgcctactaatgcagtatctgttcttcagcccataagccaaggagtaatttcaattttcaagtcttcctgcagttgacccttgaacattgtgggggttaggggtgccaaccccaacacagttgaaaatccatatataactatttttcttttgtagagataaggtcttaatatgttgcctgggctggtcttgtactcctggcctcaagcaatcctcccacctcagcctttttctttttttttttttttttttgacagagcctcgatctgtcacccaggctggagtgcagtggtgtgatctcagctcactgcaacctccgcctcctgggttcaagtgcttctcttgctccagcctcccaaatagctgggattacaggtgtccgccaccacacccagctaattttagtatttttaatagagatggggtttcaccatgttggccaggctggtcttgaactctgaccacaagtgatctgcccacctctgcctttcaaagtactgggattacaggtgtgagccactgcccctggccttggcctcatataacttttgactccccccaaacttaactaccaatagcctactgtgaaccagaagccttaccaataacagaaacagtcaattaacacatactctgcatgttttatatattatatactgtagtcttacaacaaagtaaagtagagaaaagaaaatgttattaggaaaatcataggaagagaaaatatatttatggtactgtactgtattatgtataccataagtttatgtcgtatgtttataagatgaatcatctgtctgaaatggtgggcagccacagctgcagaccccaatccacattacatatcaagcagttgaacttttttttgtaatgtcatgactttcccctgcttcttagaagcacttccagcatgactagtggcacttcacgtgggtcccgtggtgttatacaaggcttacagtattgcactaaacacaataaagaacacaggagaaccacaagagatcactttttactgtaatacataatttactggagagataaactgctcatgtggagatgattagcatcacatagcatttaaaaaattattttttctgctgcactttaaaaattcttttactttttttttttattattattttgttgatgttgagatggagtcttgctctgtcacccaggcaggagtgcggtggcacgatcttggctcactgcaagctctgcctcccgggttcacgccattctcctgcctcagcctcctgagtaagctgggactacaggcgcccgccacaacgcccggctaatttttttgtattttttttagtagaaacaggatttcctcatgttagccaggatggtctcaatctcctgaccttgtgatccgccctcctcagcctcccaaagtgctgggattacaggcgtgagccactgtgcccggcctgctaattttttaattttaaattattatgggtgtattagtccattttcatattgctatgaagagatacttgagactcggtaatttataaagaaaaagaggtttaatagattcacagttccacatgtctggggaggcctcaccatcatgacagaaggcgaaggaggagcaaagacacgtcttacatggtggcaggcaagagagtgtgtgcaggggaactgccctttataaaactatcagagctcatgagacttattcactatcatgggaaccgcatgggaccatcttggttcactgcaacctccacctcccaggttcaagcgattcttgtgcctcagcctcccaagtagcggggattacaggtgcctgccaccatgcctggctagttattgtatttttagtagagatggggtttcaccatgttggccaggctagtctcgaactcctgacctcaggtgatccacttgccttggcctcccaaagtgctgggattagaggtgtgagccaaatttttcttgagttacaaaagaagaccatagagagtcaaaggtaacaggatgaagataaggaagatcagataaagaaaactttaattaaaagggtattaaagacaataacaggcaatatgaataacagaacaaagggtaggaaaacgggtaatgcacagccatagaaatgaacaaaatcatgtcctttgcagcaacatggatgcagctgaaggccattatcctaagtgaattaacacagaaacagaaaacctaatatcatatgttcttacttgtaagtaggagctaaacattgagtacacatggacataaagatgagaacaatagaagctgggaactgcagaggggaggaagggaggagaaagggctgaaaaacttgctattgttccctacttgggcgatgtgatcagcagaagcccaatcttcagcatcacacaacatgtcctggtaacctctgcatataaaattaaattaaattgaaaaaaaggaaaagggccaggtgtggtggctcacatctgtgatcccagcactttgggaggctgaggcatgaaaattttttgaggccagaagttcaagaccagcctaggcaacacagcaagaccctgtctctacaaaaaaaaaaaaattttaaattggctaggtgtggtgatgtatgcctgtatgtctaactactcaagaggctgaggtgggaaaaaattgcttgagcccaggagatcgaggctacagagagctatgaccaccactgcactccaaactgggcgacagagtgagatgaacccatcacccccctaccataaaaaagcagaagaagaaaggaagaaaataaaaaaggtaccgagtaatcaaataactaatcttgttctgttgtattccgcaggagaaggtgacatatgtcttttcatttgggaaatgtgaatccaaggatcaacaaacaagttttattattgtgtcagttacctgttaagatactttccttggccaggcttggtggccgacatctgtgatttcagcactttgcaaggctgaggtgggtggatcacttgagaccaggagctcaagaccagcctgggcaacaaagggagacctcgcttctaaaaaaattaaaaagattagccgggcattgtggtgtgcacctatggttccagctacttgagagactgaagcaggaggatcctttgagctcgtgaggtagaggccacagtgagccttgatcatgccattgcactccatcctaggcaaaagagcaagaccccatctcttaaaaaataaataatactttaaattttagaatacattgcatgaaacttaccatcttggcttttttttttttttttgagacagagtcctgctctgtcgcccaggctggagtgcagtggcgtgatatgggctcactgcaaactccacttcccagattcaagcaattcttatgcctcagtctgctgagtagctgagactacaggcacacatcaccacgcccagctaatttttgtatttttagtagggacggggattcaccatgttggccaggctggtctcgaactcccgacctcaggtgatccgcctgtctcggcctcccaaagtgctaggattacaagcatgagcggctgtacctggcccatcttggcaatttctttttttgaaatggagtttcgctcttgtcaccaaggctggtgtcaagtagctgggattacaggcgcccgccatcatgcccggctaatttttgttttgttttgttttgtttttgagatgaagtttcgctcttgttgtctaggctggagcgcaatggcgtgatcttggctcactgcaacctctgcctcccaggttcaagcgattctcctgcctcagcctcccgagtagctgggactacaggcgcccgccaccacacctggctaatttttgtatgtatagtagagacagggtttcaccatgttgaccaggctggtcttgaacttctgacctcaggtgttccacccgcctcggcctcccaaagtgctgggattacaggtgtaagccaccgtgcccggcctaatttttgttttttttttaatagaggtggggtttcaccatgttggccaggctggtctcaacctcctgacatcaggtgatccacctgccttggcctcccaaagtgctgagattacaggcgtgagccactgcacccagccaacatcaacaattttatagaacaccacgacagagacaaggccactctatgactgtggtggatcagacaaaaacaaagccactgtgtactcatgatgtctgaacacagacaaaaacaagaacattgtccaaactatttagtcctgctcctttctcccacctttcagttgaaaattacggtactcagacatagaattacctcttcctggccgggtgcggtggctcatgcctgtaatcccagcactttgggaagccaaggcaggcagaccacgaggtcaggagatcgagaccatcctggctaacacagtgaaaccccgtctctactaaaaatacaaaaaaaattagctgggtgtggtggcgggcacctgtagtcccagctactcgggaggctgaggcaggagaatggcatgaacctgagaggcggagcttgcagtgagccaagatcgcgctgttgcactccagcctggagacagagcgagactccatctaaaaaaaaaaaaaaaaaagaattaccccttccttcctgatgcatccaaaccagagcaaaccctcttgcctcaaatcctctcctgaaacataacacgagcataagtcctacaataagtctttttttttttttttttttaattagacacgtggggtttcactatgttgcccaggctggtcttgaactcctgggcctaagcgatcttcctgccttggcattccatattgctgggcttacaggcgggagccaccatgcccagtctaagtcatcttcaacacctctttctgagatgccttagagttccccatattatgtgggtctgcctcattgctatgagtccgtaaaactgactttgttttttgttttgggttgtttttttttttttttttttagacatggtctcattctcttgcccaggctggagtacagtagtgcaatcatgacctactgcagcctcaacctcccaggctcaggtgattctcccacctcagcccccttgagtagctaggactacaggcacatgccaccacaccccactaattttttgtattttttgtagagatggagtttcatcatgttgcccaggctagtctcaaacccctatgttcaagcaatcctcccaccttagcctcccaaagagctgggattacatgcatgaaccaccacactcagtcccccaacgttgttttaaaactttcttttaggtgtgttcttggtggcccttaacagaaggacattgacactggaatctggatgtttgtttgttttggagacaggatcttgctctgtcacccaggctggagtgcagtggcacaatctcggctcactgcaacctctgcctcctgggttcaagcgaatctcgtgcctcagcctcccaagtagctgggattacaggtgcctgccaccacacctggctaatttttgtatttttagtagagacagggattcaccatattggccaggctggtcttgaactcctggcctcacgtgatccacccacctcggcctcccatagtgctgggattataggtgtgagtcactgcacccggcctggatttttttttttcagtgaaagatactgattttttttaagttgactcaaagcaagttttaaacactctgtgtccacttcatgttgctatcacagaatatcacagtctgcgtagtttaggaacaatagacatttatttggcttatggttctagaggctgtgaagtccaagatacaggagctgcctctggtgagacatcatcacgtggcaagagagcatgagagagagaaagagggggctgaatttgcttttataacaaacccattcctgaaataatggcattaatccattgacctaattgcctcttaaggatctcacctctcaacagtattacatcagggattaactttccaacacctgagatttgagggactcattcaaaccatagtactctgaaattggatatataggtctatgggtgagattcccactgagggttgccagtttgcaacctttcagttgaatggtctccctcctggatgtcaaggttaatactgctatgaacagctattatgcacctaagttgaaccagggagagaacacatccttccgcatgtactattttatttaatgttattttctactaagtcattcagaactctctggactctcttcatgctgtgtaatttgcaaggttgcctgctgcatgtttggttataaatgaggtcaaatcccaattttgcaggaggacgtggatgtatgcccattcccttcacactgtgagccagtagccatgggaactataatcaagtacacaataactcccccatgaacaaatcctcagggaacaagcttcaattgaatgaaactggcttgaccacagaggaatctgggggactttctgagcttcgcggacttgtgccgcctcctgactttaagctggctctggaggaggaggaagtggaggtatctcaggtatggacctctttctggaagctgggacttggaccaggcaaagaaaggaggcggtggggaaaattcccccagagaaggcaggagtgggccctgcataccaggtccccaggtctctgagagctttactagttctgggagtgtgtggatcaagcctaaagtctagaaggaattctagcatcacccagggcgttggctggaatatctttaaggacccttccagccctggaatcatagcagcaaaggacccaattgtatgacagctgctttggccagtgaagatggaaagaccaggaaaagctttaggctaagcaatggagttcacaccccgctaattcacctcccttgcggcatccctgacatttcccacacaatatgtccttcattctgttctccaaaaagccattgccttcctctaactgactgagatgagccctggaaaccctgatgcccaccagacccctgcctttcctcttctctgctgttggccaaggtttctgcctcagttgccctgtctgacaatacagtttccctaggactggagctagccctggcatcccagaatccccaacaggtgctagcccctggagtcaggactgtcttcctgtgtccctgtgcttgctgcagaataaactgattacttttaactaccattctgaatatagtcactaccaggaaccgctgactacctgtgacataccatctagcatggtaccacagcacctggcccagcatcttgggaggccaaggtgggaggactgcttgagggcaggagtttgagatcaacctgggcaactacatagtgagaccccacctctacaaaaaatttcaaaattagccgagtgtgattgcacatgcctgtagtcccagctacttgggaggctgaggcaggaggatggattgagcacaggaagtggaggctgcagtgagctatgattgcaccactgcactccagcctgggagacaaagggagattccgtacataaataaacaaataaataaaaaacaaaggagatggatttttttctacaagagagttacatgcagggtgctaggtactataggtggagacttgccgaggttcagtgggaatgggagctcaatcctgagagtgggggaaggcattacagaggctgtgacctttgagactggtcttgaagaaagagaaaatgtgtacaaggcagaaagaagggagaaagttacccgaagagagaactgcaccagccaaaaatatggaggtatggagtaggtagaattgtgagacatttatgtgactggagtgaaaaatgagagatgatgctggaaaggagagttaaggccaggttttgaaggatctcttaaaaaaataataggctggcgagattgtgccactgcactccagcctgggcgacagagcaagactccgtctcaaaaataataataataatagtaataataggctgggcacagtggttcacacctgtaatcccagcgctttgggaagccaaagcgggcagatcactcaagatcaggagttcaagaccagcctggccaacacggcaaaaccctgtctctactaaaaatacaaaaattagctgggcgtggtggtgtgcacctgtagtcccagctactagggaggctgaggcagaagaattgcttgaacccgggaggcgaaggttgcagtgagcagagattctgccactgcactccagcctgggtgacagagcaagactctgtctcaaaaaattaataatgataataatacattaattttgagataagatcttgctctgtcgcccaggctggagtgcagtgatataatcacagttcactgcagcctcaagctcctgggcttaagcgatcctcctgcctcagcgtcccaaggtgctgggactacaaccatatgacactgacggagcaagagcactgtcatctgggacaaacaccgcccctttaagttacagctccctttctagcctcatgcatttcaaggaaatcacttctcttctaactacaagcagacagaaagagcagacaggaaaacgcagataagacagtttgggcatagagggaggtgggggcaaagtctcttgggtaactgccaaacttcaccctcatacaacgggccccagtaaaacagtgggccttaggccgggcgtggtggctcatgtctgtaatcccagcactttgggaggctgaggtgggcagatcacgaggtcaggagttcgagaccagcctgatcaacacggtgaaaccccatctctattaaaaatacaaaaattagccgggcatggtggcgcgcgcctgtaatcccagctactcaggaggctgaggcaggataatcccttgaacctgggaggcagaggttgcagtgagcctagatcacgccactgcattccagcctggacaacagagagagattgtctcaaaacaaacaaacaaaaaaataatgggccttaataagcacatttctttcccttcagttgcactaagatagggaagttaaaagcagactcaggggatatgcctatagctgcagaaaaaagataagcacaagataagcacaacaaagagacacagaagcagtccaagcctctgataaactctcccaccctgaatccttacaaactctttgtaagaaagggtggctctgacctaacttggccagctgccaagtttattattcaaaataaacctgtccctgatgactgtcaaaccacccttcatgtttctctcctctttctttaattcttacagccaccacgcctggctaatttttttgaatttcactggaggtcttgctgtgttgcccaggctggacttgaactcctgagctcaagtgatcctctcgcctcagcctccgagtgttgggattgctggaggatcatatctgtttccaaaggtggagctttctgctggaggcagcagagttcttcaggcagagcagctgagtcttgaggttgctcttttaggaaacaaactcaggaggcgctgtggaagatgcattgaatggagtaggaggtggaggcagcgagaagggtgaggagacactgctgagccctgatgagagacaaagaatgtctgaaggaagcaaagggaatggagaggaggggaaggctttgggaagactgtgatgcatggaatgcgtgggataagggcagagggtggagtccaggctgactcagaggtttattgcctgggagactgggtagatgattacactgtaacctgagatgaagatacagtaagaggagtttatatgaagaaaaagtaggccaggcgcagtggctcacgcccataatcccagcactttgggaggctgaggcgtgtgaatcaccttagccccagagttccagatcagcctgagcaacatagagaaatctcatctctactaaaattcaaaacaattagctaggtgttgtggtgcagacctgtagtcccagctacttgggagtctgagatgggagaaccgcttgggcccaggaggtcgaggctgcagtgagtcatgatcgtgctactgcactccagcttgggcgacagagcaagacactgtctcaaaaggaaaaaacagaaaaagtaataagctcagtttttaaacagaaattgtagtagaatacaatgtaaaatttaccatttaaccattttacagtgtacaattcagtggcattaagtaaattcacaatgtttgaaagcatcaccttgatctagctccaaaacattctcatcaccccaaaggaaacccccaaatccattaggcagtgattctctattcccctgtgtgcccagcccctggcagtccctaatctccctgtagatttgcctgttctggacatttcatatgcatggaatcatacgatatgtgactatagtttatggctggccactttcacttagcacaatgttttctttctttcttttttttttttttttttgagacggagtctcgctctgtcacccaggctggagtgcagtggcacgatctcggctcactgcaagctccgcctctcggggttcacgctattctcctgcctcagcagagtagctgggactacaggcgcccgccaccacgcccggctaattttttgtatttttagtagagatggggtttcaccgtgttagccaggatggtctcaatctcctgacctcgtgatccgcctgcctcggcctccctaagtgctgggattacaggcgtgagccactgtgcccagccagcacaatgttttcaaggttcatccatgttatagtatgtatcagaattcttttttttggagactcagagccccattttttttggagactcagagtctcattctatcacccaggctggagtgcagtggtgcaatcttggctcactgcaacctctgcctcccaggttcaagtgattctcctgcctcccgagtagctgggataataggcaaacgccaccatacccagctaatttttgtatttttagtagagaaagggtttcgccatgttggtcaggctggtctcgaactcctgacctcaagtgatctatctgccttggcctcccaaagtgccgggattataggcgtgatccaccgcgcctggccccttacccatttttcaattggtcaattttctttttcttattgaattgtaagagttatttctatgttttaaatacaagtactttatcagatgtaagatttgcaaatactttttcccattcggtgagctgtcttttcaccttgtggctggtattcttttttttttttttttttttgagacagagtcttgctctgttgcccaggctggagtacagtggcaggatctcggctcactgcgagctccacctcccgggttcacgccattctcctgcctcagcctcctgagtagctgggactacaggcgcccgccaccatgcccggctaattttttgtatttttttttagtacagatggggtttcacggtgttagccaggatgctctctatctcctgacctcgtgatccacccgccttggcctcccaaagtgctgggattacaggcgtgagccaccgcgcccggccttgtgggtggtattctttgaaacacaaaactttttattttgatgaagtcccctttatctatttttacttttgttacctgtgcttttggtatcatatctaagaaatcattgccaaatacaatatgatgaagattttcccctatgttttattctaggatttttatggtttttgcacttaagtttagatctttgatccattttgagttaattttttgtatgtgagctaagctttctatgtggggtacagaaaagggctaacctcattattttgcatgtttcccccaccccctgcccaccaacatttgtcaaaaatacgaatcctttcccccattgaatagtctaaacaactattttcaacaagggaaaatagttgaaaatcaattgttgaaaatcaattaaccatatatgtgaggatttatttctgggttctctattctactccatttgtttctctatctacccttaggtcagtatcacactgggttttttcttttgtttgttttaactttttaaatttcttgtttttaatttttgtgggtacgtagtaggcatatatatttatagggtacaggagatactttgatagaggcatgcaacgcataataatcacatcatgataaatggggtatctatcccctcaagcatttatcctttgtgttacaaataacccagttaaattctttcagttattttaaaatatacaattaaattattattgactggcctggcgcagtggctcgtgctgtaatcccagcacttttggaggccgagatgggcggatcatttgaggccaggagttcaagaccagcctgaccaacatggtgaaactccatctgtactaaaaagacaaaaaaagttagccaggcctcaggcgcctgtagtccccactactcaggaggctgagacaggagaatggcgtgaacccaggaggcagagcttgcagtgagctgagatcgtgccactgcactctagcctgggtgacagagcgagactccatctcaaaaaaaaaaaaaaagttagccaggcctaggggtgcacgcccatagtcccagctacttgagaggctgaggcaggggaattgcttgaacctgggaggcggaggttgcagcaagccaagatcatgccactgcactccaccctggttgacagagctagactccgtctcaaaaaaaaaaaaagaatggcctggcgctgtggctcatgcctgtaatcccagcactttgggaggccgaggcggggggcagatcatgagatcaggagttcgagaccagcctgaccaacatagggaaacccgtctctactaaaaatacaaaaattagccaggcatggtggtacatgcctgtagtcccagctactcaggaagctgaggcaggagaatcgcttgaacctgggaagcagaggttgcagtgagccaagatggcaccactgtactccagcctgggcaacagagcaagactctgtctcaaaaaaaaaaaaaaaaagaagaatcatattgctaaaaaaaatagtttttcattctgtctatatgtcataagtgagatgacttgaactccctaagcatatgtgtccattatttccaccattaaaatgaattaaggtgcttggcatgactgccccctgtttattagttctaatagttttttagtggagtctatgttttttctaaatataagatcttatcatctgcaaacaagaataatttttacttcttcctttccaatttggacgccctttgtttctttctcttgtctaattgttctagctaggtcttccagtactatgctgaataacagtggtgaaagtgggcatccttgtcatgttccagatcttagaggaaagtctttcgggttttcctcattcagtatgatactagctgtgggtctgtcatatatggtttttataatgttgaggtatgtttcttctacacccagttttttgagggtttttattatgaagtagtgttgaattttatcaaatgctttttcagcatcaattgaaatgatcatatggtttttgtctttcgttttgttgatatgatgtaccacattaattgatttgtgtatgttgaaccatccttgcatccctgggagaaattccacttcgtcatgatgatctttttttttttctgaggtggagtcttgctctgtcacctaggctagagggcaatggcacaatctcagctcactgcagcccctgcctcctgagttcaagtgattctcctgcctcagcctccccaggagctgggactacaggtacatgccaccacacccagctaattttttttattgtagagtcaacattttgccatttacccaggcaaaatgagtaacattgtgacctcctgggttaaagtgatcttcctgccttagcctatcaaagtattgggattataggcatgagctaccatgcccagccaaatactatcttattacccattattttaaactgataactgatgacaacttttttttttttttgagacagagtctcgctctgtcgcccaggctggagtgcagtggcacgatcttggctcactgcaagctccgcctcccgggttcgtgccattctcctgcctcagcctcccaagtagctgggactacaggcacccgccaccgtgcccaactaattttttgtatttttagtagtgacggggtttcactgtgttagccaggatgatctcgatctcctgacctcgtgatccacccgcctcggcctcccaaagtgctgggattacaggcgtgagccaccacgcccggcaaactgatgacaacttaacactggttgcataaacaaacaaacaagcaaaatgaaaaaaaaaataataaaaactctacactttaacttcctccccccctgctttttttttttttttttttgagatggagtctcactctgtcgcccaggatggagtgcagtggcgctatctcagctcactgcaacctctgccttccatggttcaagcgattctcctgtctcagcctcctgagtagctgggactacaggtgcacaccaccacacctggctaatttttgtatttttagtagagacggagtttcaccatattggttaggcttgtcttgaactccagaccttgtgatccacccgcctcagcctcccaaagtgccgggattacaggcatgagccaccgtgtccagcccccactgctttttaatgtggttccctttatgtcttattgtactatgccttgaaatgttgtagttattgtttttttattggttcattgtttagcttttctacttaagagtagttggccaggcgcagtggctcatgcttgtaatcccagcactttgggaggcctaggtgggtggatcacctgaagtcgggagttcaagaccagcctgaccaacacggagaaaccctgtctctactaaaaatacaaaattagctgggtgtggtgatacatgcctataatcccagctactcgggagactgaggcaggagaatctcttgaacccgggaggaggaggttgcagggagtcgagatcgcaccattgcactccagcctgggcaacaagagtgaaactccatctcaaaaaacaaaacaaaacaaaacaaaaacagataatggtagtttatataccaaaattacagtgttataataccctgtatttttctgtgtgcttgctattaccagtgaattttgtaccttcaaatgatttcttattgctcatgaacatccttttctttcagattgaagaactccccttagcatttctcgtaggacaggtctggtgttgatgaaacccttcattttcgtttgtctgggcaagtctttatttatccttcatgtttgaagaatatttttaccagacatactattctagggtaatttttttttcttttagcactttcaatgtcatgccattctttcctggcctgtaaggtttccactgaaaagtctgctgccagatgggaattggagctccattgtgtgtttttttgtttgttgtttgtttgtttgtttttctgagatggagtctcgctctgtcgcccaggctggagtgcagtggcgggatctcagcttactgcaaacttcacctcccaggttcaagcgattctcctgcctcagcctcctgagtaactgggactacagacatgcaccaatacacatgtgtgtgtgtgtgcgtgtgcgcgtgtgtgtgtatttttagtagagacggggtttcaccatgctggccaggctggtcgtgaacttctgacctcaggtgatccacccacctcagcttcccaaagtgctgggattacaggcgtgagccaccacgccttctaatgcattctttagtatgtcaattgcattttccaactctagaatttctgcttatttttagttatttcaatctctttgttaaatttattgatagaattctgaattccttctctgtgttattgtgaatttctttgagtttcctcaaaacgtcttttttgaattctctgtctgaaaagtcccatctgtgtttctccaggattagtccctggtggcttctttggttcatttggtgaggtcatgttttcctggatggtcttgatgcttgtcaatgttcatcagtgtctgcacattgaagagttaggtatttattgtagcctttgcagtctgggcttgtttgtgcccatcttttttgggaaggctttccaggtatccaaaaagacttgagctccaagcccaataacactgtggttcttgtggactcatataagtaccaccttggtggtcctagataagatccagatgaattctctgattactaggcagagactcttgttctctttccttactgtctcccaaataaatggagtctctgtctctttgctgagcttcctggagctaggggtggggtgatgcaagccttcttatgaccaccaccattaggactgtgctgggtcatacctgaagccagcacagcagtgggtctcacccaaggcccactgtaaccactacccgaataccatctatgttcactcaaggccctagggctctacaatcagcagctagggccaccagtctgatttctatctttcccttcagggcagcgagttcctccaggtcctgggagggtccagagataatgtctgggagccacggattagagtcaaaaaccttagaaatctacctggtgttctattctactgcagctaagctgggactcaaaccacaagacaaagtgcctcccactctaccttcccctttccatggacagaggacagaggagcctctcccagtggccactaccaccactggcctgcagagagttctgaacactcacttaaagcccaaggcctcttcaagtcaacttgtggtgaatgctctcaggcctgggactcaccctttaggacagtgggtccccctctggcccacagcaggtccaaaaatgttgtccaagagcttaggtctggactcggggaccccaaaaatctgcttggtaccctaccccactgtgtccgagctggtatctaaggggcaagacaaagttccctttactcttctctccacttttctcaagcagtagtctttcaccagggccaccacagctggtaatgtgctgggccctacctgaagccagcacaactcagactcttatccaaggtccacagatactacctgggtattgctgttggctattcagggaccaagggctccttagtcagcaggtgataagcccttccaggactgcgtcctcccttcaggacagcaggctcccttctggcccagcgcatgtctaaaaatgtcatccaggagctagggcctggaatgagggcctcatgactgcctggtgctctatcctattgcggctgatctggtatccaagatgcaagacaaagtcctctttactctttgctttcctctcctcaaacacaaggaaggagttactttcgttgctgtgagctatgccgcctggaatcgggggaagggtggtgcatgcactcctttagctgccccaactactgcctagctaggtcatgtgccatcctagtccactggctctaaggccagcccagcactaggacttgcctagaagttgcagtccttgtatcctaaaatgcctttcaaatttacctaggaccccagagcactttagcctgcagtggcaaggcttgccgcaacttgagttctgaccactaggatggacaattcccctctggttcgggctgatacaaatgctccctccttgggcaggcactggctgagtccagcatggctttgctctccactgtgacagggcagcactgagttcactggcaagtccctcagttcaatgccaagtcccccagtccatgtgctctctctcctccaagtgcacagtttctctctgtgccatgcagctactgctagggggttggggaggggtggtgtcagcgattcaagacagtgtttcctgcccgggcacggtggctcacacctgtaatcccaacactttgggaggccaaggcaggcggatcacttgaggtcaggccaacatggtgaaatcccgtctcactgaaaatacaaaaacccggcgggcgtggtggcacatgcctgtagtcccagctactagggaggctgaggcaggagaatcgcttgaacccgggaggcagaggtttcagtgagccgagactgcaccattgcactccagcctaggcaacagacaaagggagacttcatctcaaaaaaaaaaaaaaaaaaaaaaaggctgtctttcctaccctcttcagtgcctctttcagtgatatgaagttaaaatcagctactgtgaccactcacctgatttttggttcttatgatggttctgaggaggcttctattctgccatcttgctctgacttcccactacattgtgttttgtttgtttgtttgtttttgacattcactctgtcacctaggccggagtgcagtggccaaatctgggctcactacaacctctgtctcccaggttcaagcaattctcgtgcctcagcctcctgagtacctgggattacaggcgcttgcccccactccggctaaatttttgtatttttagatggggtctcaccatgttgcccaggatggtattgaactcctggcctcaagcgatcctcccgcctcagcctcccaaagtgctgggattacaggcatgagccaccacgcttggcccccctacagtttttgtttggttgtttgtttgagacagagtctagctctatcccccaggctggagtgcagtggcgaaatcttgtctcactgcaacctccgcctccggggttcaagcgattctcctgcctcagcctaccgagtagctgggattataagcactcgccacccagttaatttttgtatttttagtagagatggggtttcgccatgttgaccaggctggtctccaactcctgacctcaggtgatccacccaccttggcctcccaaagtgctgggattacaggcgtgagccactgcacccagcccctacactgttttgattatgatagctttgtagtaagttttaaaatcaggaaattgagtccttcaactttttttcaagaccattttggtattcagggtcccttgagattctgtatgaattttaggatgggtttttctgttccactgccctccagcctgggtgacagagcgagactccatctcaaaaacaaaaaaacaaaaaaaaaaatcatagggatttgatatgatttgttaggaatttgcattgaaactgcagatcgctttgggtagtattgccatcttaacactattaagtccttcaatccatgaatgtgggatgttttctcttttgggggtcttctttaatttatttcagcagtatattgtaattttcagtgtacaaatctttgagctccttggttaaatttctaagtattttattattttgatgctattgcaaaggaagttattatttaaatttccttttcaaattgtttgctgcaagtgtataaaatctgagttgattttatgtcctgcaactttgctgaacttaattctaaaatttttgtgtggatttcttatgatttttctatatataattatataatctgtgaaaagagatccttttacttcttcctttccaatgtggaagtcttttgtttcttcttggcgaattgctttgcctagaacttctagtactttgttgaatagaagtggtgagagcaggcatccttgtcttgttcctggtctgagggtacaagcttttagtctttccctgtagagtatgatgttagctgtggtttacggcctttatcatttggaggacattcctgtctatttctagtttattgagtgttttaatcatgaaaggggtttggctgggcgcagtggctcactcacgcctgtaatcccagcactttgggaggccgaggcaggcagatcacctgaggtcagaagttcgagaccagcctgaccaacatggagaaaccccatctctactgaaatacaaaaaaattagccgggtgtggtggcgcttccctataatcccagctactccagaggctgaggcaggagaattgtttgaacctgggaggcagaggctgtggtgagccgagatcacgccattgcactccagcctgggcaacaagagtgaaactccgtctcaaaataaataaataaataaataaataaataaataaataaataaataaataaaatcatgaaagggtgttcattttttcaaagccttttctgcatcaattgagatgaccatgtgttttctccccggttcattctattaatgtggtgtattacattgatttttttcttttttttaagacagagtcttgctctgtcgcccaggctggagtgcagtggcttgatctcagctcactgcaacatctgcctcccaggttcaagtgattctcttgcctcagcctcccaagtaactggtattataggcacctgccatcatgcatggctaatttttgtatttttagtagagacggggtttcaccatgttgggcaggcttctctcaaactcctgacctcaggtggtctggctgcctcggcctcccaaagtgctgggattacaggtgtgagccactgcacccagccacactttgcatattttgaagtgcatctatttacttagcattcgtgacttgaataatttcaccaaatgaataattttgggtagtttgaaattcgttcttccaattgttacaccttgtttggtgtttgtaataaacacgtaaaggtaaaaaaaaacagtttttctgtattctgccaatcatacttttatataataaatcatccatttttttcccataaaaaaaaagaaagttattgcttaatgttacagaatttctgtttggagtgatgaaaaagttttggaaatagtagtgacagttgcacaaaattgtgaatgtaattaataccactgaactgtgcacttaaaaatagctaaaatggccaggtgcagtggctcatgtctgtaatcccagcacttccggaggccaaggcaggtggatcacctgaggtcaggagttcaagaccagcctggccaatacggtgaaacctcgtctctactaaaaatacaaaaaattagccaggtgtagtggcagacacctgtaatcccagttacttgggaggctgaggcaggagaatcacttgaactcaggaagtggaggttgcagtgagccaagattgcaccattgcattccagcctgggcaacagagcgagatctgtctcaaaaaaaaaaaaaaaaagctaaaatggcaagttttatattatatatgttgtttaccacacacacacacacaaatactaagaaaaaaatcaggcagatcctcttctaacaacacttacagtctattaagtgaatctgggcattttaaagaaaaaaataactatttttggttacggaatcaggatagtagttgcctatggacacgggcagtggggactgactagaaagggaagggaaggaagttcttggacctagaagtgttttatgtcttgattggggtgtttagataggcattacatttgtcaaaactcatgaaattttatactttaagatctgtgcatttcactctatgtaaattttaccttagtaaaaaacaaaacaggctgggcgtggtggctcacgcctgtaatcccagcactttgggaagccaaggtgggtggatcacttgtagtcagaggtacgagaccagcctagcaacatggtgaaaccccatttctactaaaaatacaaaagaaattagctgggtgtggtggcaagcgcctgttatcccagctacttaggaggttgaggcaggagaatcgcttgaacctgggagctggaggttgcagtgaactgagatggacccactgcactccagcctaggtgaccgagcgagactccatctcaaaacaaaacaaaacaaaaaatgttagcaacttctaatcccttgacagtttatatataccgcagtgattttctcccacttctcactcacgtgggatcttatcatacagaggttttaaattttaaacaattaaatttatcaaccttcttcatttatggtttctatatttgtgtgtcttgcttcagaaagtatctcttattccaggtaatcatattatcctatttttaaattctattttggaataaatatttcttattccaggcaatcatattattctattttttttctatatttttattgttctttcctgtgtgggacatgtagctggtgggctagctgcagaccacgggcaagtttgctaacattgctaagtcttggttttctcatccataaaatagggataataatttgctttgttattgacatgatttaataaagtaatatttatttgtttatgtatttattttagagacagggtcttactctgttacctaggctgaagtgcagtggcaatctcggttcattgcagctcaagtgatccttctgccttagcctccagagtggctgggactacaggtactgggactacaggatgggactacagagtggctgggcatccagctaacttaaaaatttttttgggctgggtgcagtggttcatgcctgcaatcccagcactttgggaggccgaagagggattaagaggtcaggaatttgagaccaacctggccaagatggtgaaaccccgtctctactgaaaatacaaaaattagccgggcgtggtggcaggcacctgcagtcccatcaggaggctgaggtgggagaatcgcttgaacccgggaggtggaggtggcagtgagccgagattgcgccattgcactccagcctgggctacaagagtgaaactccaccttaaaaaaaaaaaaaaaaagccgggcgcggtggctcacacctgtaatcccagcactttgggaggccgaggcgggcagatcacgaggtcatgagatcgagaccaccctggctaacatggtgaaaccctgtctctactaaaaaatacaaaaaattagctgggtgtggtggcaggcacctgtagtcccagctacttgggagactgaggcaggagaatggtgtgaacccaggaggcggagcttgcagtgagcagagatcatgccaccgcactccagcatgggcaacagagcgagactccgtctcaaaaaaaaatttttttttggccagtcacgatgtgtcacacctgtaatcctagcacttagggaggccaaggcgggtggatcacttgaggtcaggagtttgagaccagcctggccaacatggtgaaaccccgtctctactaaaaatacaaaaattagccagggacagtggcatgcctctgtaatcccagctactcaggagactgaggcaggagaatcacttgaacccaggagttggaggttgcagcgagccgagatcacaccacttcactccagtctgggcgacagagcaagactccatctcaaaaaaaaaaagtctagatggggccgggcagggtggctcacacctgtaatcccagcactttgggagtctgaggcgggtagacggcttgagctcaggagttcgagaccagactgcacaacatggtgagaccccgtctctactaaaaatacaaaaagagagaaaaaaaaatagcttggcatggtggtgcacacttgtggtcccagctacttgggcggatgaagtgggaggattgcttgagcatggtgaggagggaggttgcactgagccaagattgcgccactgcccaccagcctgggtgacagaccaagaccctgtctcaaaaaaaaaaagaaacaaaaaaaaggtggggctcactggctcacacctgtaatcccagcactttgggaagcttaaggtggatggatcacttgaggtcaggagttcgagaccagcctggatgacatggcaaaaccctgtctctactaaaaatacaaaaaaattagctgggcctggtgacgcacgcctgtagtcccagctactagggaggctgaggcaggacaattgtttgaactcaggaggcagaggttgccgtgagctgagatcgcaccactgcactccagcctgggtaaccagagtgaaactctgcctccaaaaaaaaaaaagaagaagaagaaaaaaggtttaggcaaacatgcacttttcctgttgcttttttttttttttttgagatggagtttcgctcttgttgtccaggctggagtgcaatggcgtgatctcggctcactgcaacctccgcctcctgggttcaagcgattctcctgcctcagcctcccaagtagctgagattacaggcatatgccaccacgcccgaataattttgtatttttagtagagatggggtttctccatgttggtcagactagtcttgaactcccaacctcaggtgatcctcccgcctcggcctcccaaagtgctggggttacaggcatgagccactgcgcccagcctgaacatgccagattgtagttccaggaggccagagatcatgaatactttgtccaccactatattcccagcccacagaatacacagcctggcagccaacagatgcttattgaatgaacgagcctcaacagggctttctcattcccacatgccatgctgtggtcaggcttaaatcataacccaacttctgccacctaatatatgtatgaccttggttaaattaaaccagcagtccccaacctttttggcactggggaccagtttcatggaagacaatttttccaccaggggaggaatggtttcgggatgattcaagcacattacatttattttgcactttatttctattattattacattataaggtataataaaataattatacaactcatcataaagtagaatcagtgggatccctgagtttgttttcctgcaactagatagtcccatctgatgttgatgggagacagtgagagatcatcaggcattagattctcataaggagcaacctagatccctcgcatgcgcagttcacaataggattcatgctcctatgataatctaatgccgctactgatctgacaggaagcagagctgaggcggtaatgcaggcaatggggagtagctgtaaatacagatgaagcttctctcaccagccattcacttcctgctgtgcggctcagttcctaacacgtcacggactggtactggccccacggcccaggggttggggacccctgacttaaactaagggccagctttccagaataacatccactttgagggcttgttgagtggattaagtcaaaatgttggtatacttggctggtgcggtggttcacacctgtaatcccagcacttcgtgagtctgaggcgggtggatcacctgaggtcaggaatttgagaccagcctggccaacatgatgaaaccccatctctactaaaaatacaaaaaattaggccgggcgcggtggctcacgcctataatcctagtactttgggaggccaaggcgggtggatcatttgaggtcaggagtttgagatcagcctggccaatatggtgaaaccctgtctctactaataagtacaaaaattagtcaggtgatagtggcgtgtgcctgtaatctcagttactcgggaggctgaggcaggagaatcccttgagcctgagaggcagaggttgaggtgagctgagattgggctgttgttgagttgtaggagttctttatatattatagatattaaccccttataagatatatgatttgatatttcctctcattctgttggttgccttttcactgtcctttcctttttttgtttttgttttttgtggggcagagttttgatcttttgcccaggctggagtgaagtggtgcaatctcagctcactgcaacctccactccccaggttcaagcgattctccagccttagcctccggagtagctgggattataggcgcccggcaccatgcctggctaattttgtacttttagtagagatggggtttcaccatgttggccaggctggtctcaaactcctgacctcaggtgatccacccgcctcggcctcccaaagtgctaggattacaggcttgagccaccgtgcccagcctgttgtgtccttcgatgcacagaaaagactcttttctctactgaacgcccacagcacccttgtcaaaaatcatttgactagtcagggcacagtggctcacgcctgtaatcccagcactttgggaggccgaggcgagaggactgcttgaggtcaggagttcgagacatgcctgggcaacatggcaaatggcaaaaccccgtctctacacacaatgcaaaagttagctgggcatggtgggtggcgtgtgactaccggctgtctcaactacccaggaggctaaggcgggaggatctcttgagcccaagacgtccagactgcagcgagctttgattgtgccactgaactccagcctgggcgatgacagagcaaggctctgtcaaaaaaaaaaaaaaaaaaaaaaaaaaatcggccgggtgtggtggttcacgcttgtaatcccagcactttggggggccgatgcgggcagaccacgaagtcaagagatcaagaccatcccggccaacatggtgaaacctcgtctctactaaaaatacaaaaattagctgggcgtggtggcgtgcgcctgtagtcccagctactcggaaggctgaggcagaagaatagcttgaatccgggaggcggaggttgcagtgagtcgagatcgcgccactacactccagcctggcgacagactgagaccccgtctcaaaaaaaaaaaaaatcatttgtatatgcgaaggttttgtgccacaaacttttgtggctgttgatacaaacgacatggcctctgccttaaggaagccacagtcgaattaaatagattccgtttcaagtagcatctgtcctgtgtgcttagtgggcactgggcccatgttttcccacattttaccctttaagcttctgatccaaccggtgagatagataggatgatcctctttagtagaggggtaagcttagtcccctgagagcgcggctatggcttatgcgagggtacggacagtcaggatttgaacccaaagttcctggctccatgtgtcatgctacctccagtcagatgttctcacctccaaaacttgggcagaagtgaactgagatgctctctactgagcaactcttcagctccagcatcctatacattaaggagtcactaaaagtcagggtccacgagaaaggtgcagatcggggtgcacagaagagcggagtccaaaacaccactcccagccccagtggacagagtcctcaagtggcagccctgcaactctgagcggatgccgagtcctcaccgggaacccgggcgcggctggtctgtgctattggcgcgggtaggggacgcacagcccaaaaatgcccgcgacaagcttctggggcagttctcgccagtctctctggagggagcctacgggttctgcgacgtttctcgcacttgctccctggcctcgctcccgtttccacccctcccacggaggttttcctttctggtggctccttccttgggtgtccctttggtacgcccccaccctggcggtgagctgcgaggctggcgcccgcgtggccactgcgcatgcggacccggccgcggggcggggccgcgcgaggaggagggtcggggacggaagcgcagagcacggaccccgccccctcgcggccccgctcgtgacgtcgcggggggcgccggcctccgcccggccccgaggggtaagagcgagcggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctgagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggtaagttccccacccccgtacccgctcttccttccaacctagacaggcttttgctgctaatctcatctcacccgtcttcttttgctcacaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggtgagatcagaggctgggtgtggtggctcacgcctgtaatcccaacactttgggaggctaaggtaggtggatcatttgaggtcaggagttcaagaccagcctggccaacatgatgaaacaccatctctactaaaaatacaaaaattagccaggcatggtggcaggcgcctctaatcccaactactcgggaggctgaggaaggagaatcgcttgaacccaggagatggaggttgcagtgaaccgagatcgcaccattgcactccagcctgggtgacagagcaagactctgtctcaaaaaaaaaaaaaaaaaaaatcaggtgcggtggctcatgcctgtaatcccagcactttgggagtccgagaagggcagatcacgaggttaggagttcgagaccagcctggccaacatggtgaaaccccgtctctactagaaatacaaaaattaacctggtggtctggttgcggtggcccacagcggtaatcccagcagtttgggaggccgaggcgggcagatcatgaggtcaggagtttgagtccagcctgaccaacatggtgaaaccccatctctactaaaaatacaaaaattagccgggcatggttgcacgtgcctgtaatcccagctactcaggaggctgaggcaggagaatcacttgaagccaggaggcggaggttgcagtgagccgagatcgtaccactgcactccatcctgggcaacagagcaaaactcggtctcaaaaaaaaaaattagccaggcttggtggtgcaagcctgtagttccagctacttgggaggctgaggcaggagaattgcttgaacccgggaggtggaggttgcagtgagccaagatcgtgccactgtactccagcctgggagacagagcaagactccgtctcaaacaaacaaacaaacaaaaatacaaaaagtagccaggtgtggtggcaggtgcctgtagtcccagctacttgggaggctgaggcaggagaatcgcttgaacctgggaggcggaggttgcaataagcagagatcacaccactgcactctagcctgggcaacagagactctgtcccgccccgcgccccccccaccaccctgcgccaaaaaaaaaaaagtaaggtgagatcacagaggactgtggggtcgggtatcagaacactcagggctgggccctgcctctgacctcaccaatgatgaccttgggcacatccctggactttagtcacttctgtgattagggctttcagtgaacatgctgccgacagggtaggttttctatgaatgctttcttcctctgccagttctgatgttctttgagtctatccttggaggtaggatgaaatgggctaggtttgacctaatgttttctcatcctttagccacctcctcctagaggcccctttttccttagcatagttctgtatgccacaaaagatgcagaaaaaaattagacaccatcaatttccaaagagctatagtcttctgggaaaatgacaagcgatagggagaatgtgaaaatgtcagtggatgccaataatccctgtgtgacatttggccttatctaaaatatgctaagataaagagggatggaagagggtggtattttctgacttctgaggtcctttacaacactatcattctaagattctcctgtgagtatatatgtgtcgggggagtgggtctctgcatgtccagatgtacatgtatgttaacaaaaataaggaatgtgtccgatatatgcagacttgggacaattctttcccattctttttacttttaaatagatatataatagttttattgagatatgattcatgtaccatacaattcacccattgaaagtgtacagttagggccggatgtggtggctcatgcctgtaatcccagcactttgggaggccaaggcaggcagattgcttgagcgcaggtgttcgagaccagcctggacaaaatggcaagactctgtctctactaaaaatacaaaaaaaaaaaaaaaaaaaagccaggcgtggtggtgcacacctgtggtcccagctacttgggaggctaaggtgggaggattgcttatccctgggaggcagggcttgcagtaaacattctcctgcctcagcctcctgagtagctgggattacaggtgctcgccatcacgctcacctaattcccgccccccagcccaaggagtcttgctctgtcacccagactggagggcagtgatgcgatctcagctcactgaacctctgcctcccagtttcaggagattctcctgcctcagtctcccaagtagctgggattacaggcatgtggcaccatgcccagctaatttttgtatttttagtagagatggggtttcaccatgttggccaggctggtcttgaactcctgacctcatgatccgcccgccttggcctcccaaagtgctgggattacaggtgtgagccactgcgcctggccaatttttgtattttttatagagatgtggtctcactatgttgcccaggctagtttcaaactactgggctcaagtgatcctcctgcctcacctcccaaagtgctgggattacaggcatgagctaccgggtctggcgtattacccaattgttttatttactttctcttgattgctagtaaggttgagcctcttatggtttattgtctgtattcatgttgcctgtgaattacctgtttgtttcctttgttcctttttcttttaagttatttgtctttttcttcttgatttgtaggtctttattctagatagtaaaccttttgtcatttaaatatattataggtattttcaatatgttacttgtttttttaacttatctttcattgcatagaagtctttaatttttatgaggttaggtttatcactcttgtcctttattaaaacttttaggttttgtgtctttcataggaagcccttcctcattttaaaattagaaaatattctggccaggcgtggtggctcattcctataatcccagcctttggaaggctgaggcaggtggatcacctgaggtcaggagttcaagactggcctggccaacatgatgaaaccccgtctctactaaaaatacaaaaaattagccaggcatggtcgtgggcacctgtaatcccagctactcacaaggctgaggcaggagaattgcttaaacctaggaggtggaggttgcagtgagctgagattgcaccactgcactccagcctgggcaacaagagtgaaactctgtctcaaaaataataaaataaaataaaataaaataaaatattctgtattttctttaaatacttaagtttttttttagtttgtatagttctttaatacatctgaactttattttataagataacagtttgacgctatgtttttttctacatggaaattttcccaaggccatttactgaggccatcctttccccactaatttaaaatagggtgagaaccttttaatggattttggtaccaagtgagaaactgctttcttaaaaagaatgaactagtttatgcaaactgacatgggcaatgtgtatctgcccatttcactgcagccttgcgagtattagtatggttgttgtattgattgtaatttaagttaatttaaattacaacttaatttgtgtttatattgatacaaagttattttcatttctcagtgatataaataatggtatatggaatactttattgaatagaatcaatgccaaaacacctggtattatagaaagccttaaaaaatgactaggggcaggcgtggtggttcatgcctggaatcccaacattttgggaggtcagggtagcaggatggcttgagcccaggagtttgagtccagcccgggcaatacagtgataccctgtctctacaaaaaaatttttttaaattagccaggtaggtggcacacacttgtagccctgcctactcaggagactgaggtgggaggatcacttgagcctaggaggttgaggctcccgtgagctgggatcgtgccactgcactccaacctgcacgacaaagtgagaccccatctcaaaaaaataaagaaagaaagaaaatacaagaaaagggccgggcacggtggctcacgcctgtaatcccagcactttgggaggccaaggcgggcggatcacgaggtcaggagatcaagaccatcctggctaccacagtgaaaccccgtctctactaaaaatacaaaaaattagctgggcctggtggtgggcacctgtagtcccagctactcgggagactgaggcaggagaatggtgtgaacccgggaggcggagcttgcagtgagccgagattgcgccactgcactccagcctgggtgatagagcgagactccgcctcaaaaaaaaaaaaagaaaatacaagaaaagaagcgtgaagacagaggctcccgcgtcacctctcattttcttccattttctcttctgtgcctttcacaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggtaagagcctcagatgggtcgccagggttttgtagactgcctgctgactactgtatcttgaaggtccctggaaacaattctaccttgtagaaaaagcacaggttttataaccctgccttgggggctgtgtgacgtagaacaagtgtctaaacatctctgagtgtcagcatcctcatctgtaaaacagaaaacatgaccctatctcttaattccatcaaataaggattaaatgagaatgaccgtgaagtgcccagcacattgcctgggacatagagatttgataagtgacagctattgttgtttactattgtctttaaaacattctctctacttcaaaggagttcagaagctataataagaggcaaatgggctaattgctattagagagatgtgagcaaagtgttatgcaaacacagagaaaggagccattaaccctaacttgaacatttatggagagtgcatcacagagaaggtggcatttaccagagagcattgtgcacagtggtttataatgcacaaagtgctctcagggttcattaattcatttgatcttaaaatagccttttgaggtaggtgttattatcccattttacagatgaggaaacaggtttagagaaagggagtgaattgctgcaggccacacaactggttaagtggcagagccagggttgcaacccacaccttctgtcaagtcagaatgatccttgaagaatgaggaagatttggacagggactgcagtagaggaggttcaggagagggggaggtacactccaggcaaaggcaccagcatgcgcacaggcctagagattgaaaagtgttcagccaggtgtcacatctgtaatcccagcactttggaaggccgaagcaaggagaatgcctgaggccaggagttccagaccagcctggagaacatagcaagacctcgtttctttttcgcttttttttttttttttttttttgagacggagtctcactctgttacccaggctggggtgcagtggcacaatctcggctcactgcaagctccacctcacaggttcatgccattctcctgcctcaggctcccgagtagctgggactacaggcgcctgccaccatgcccggctaatttttgtatttttagtagagacagggtttcaccttgttagccaggatgatctcaatctcctgacctcgtgatccacccacctcagcctcccaaagtgctgggattacaggtgtgagccactgcgcctggcgaccccatttcttaaaaaaaacatttttttttttaattagcagggtgtggtggtacacacctatagtcccagctactcaggaggctgaggtgggaggatcctttgatcccaggagtttgaggctgcagtgagccatgattgtgccactgcactccagcctggttgccagagtgagaccctgtctcaagaaggaaaaaaaaagaaagtgttcagcctttgggagcactccatgttgagaggcttaggaaggagaaaaggcaagagagaccacagggatttgatggagaggctctgtgaatgcaggatagagggctatgacctgatgctgaaggccgtgggggccactgaggagttttaaggaggagagagatgtgcttccctggtgctgggtggagaatggctgagtggaggagggccatcagtcaggaggctgctgcacactccactctcacatttgaaaataccccatgaggcacggtggctcacgcctgtaatcccagcactttgggaggccaaggccggtggatcacttgaggtcaggaccagcctggccaacatggtgaaaccccatctctactaaaaatttaaaaattagctggatgttgtggcgggcgtctgtgatcccagctactcaggaggctgaggcaggagaatctctggaacctgggaggcagaggttgtagtgagctgagatcatgccactgcactccagcctgggcaacagagtgagactccgtctcaaataaagaaaaaaagaaaagaccccatgaggagcacaacctgggacttggaatcagagatctggtttccagatctagcactgcttgcactttttttttttttttttttgagatggagtcttgctctatcgcccaggcgggagtgcagtggcgcaatctcagcttactgcaagctccgcctcccaggttcacgccattctcctgcctcagcctcccaagtagctgggactacaggcgcccgccaccatgcccggctaagtttttgtatttttagtagagatggggtttcactgtgttagccaggatggtctcaatctcctgacctcgtgatccacccacctcggcctctcaaagtgctgggattacaggtgtgagccaccgcacccagccacttatacatctttaaactgtggatcataatgaagtttcctatctcatggagttatgatggggtttcaggttgataattgggcaagaaagtagtttttaaaccatcaagacaaatgttcgagcctgggcaacatggtgaaaccccatctctacaaaaaaacacacaaaaaattagctgggcgtggtggcacacacctgtggtcccagctactcaggaggctgaggtgggaagatcgctggagcccaggaggcggaggttgcagtgagccgagattgcactactgcactccagcctgagttacagagtgagaccctgcctcaaaaagaaaaaaaaaaaaaagggccaggcgcggtgtttcacgcctgtaatcccagcactttgggaggccgaggtgggcggatcatgaggtcaggagatcaagaccatcctggctaacacggtgaaaccccgtctctactaaaaatacaaaaaatgagccaggcgtggtggcgggcacctgtagtcccagctacttgggaggctgaggcaggagaatggcgtgaacccaggaggcggagcttgcagtgagctgagatcgcgccactgcactctagcctgggcgacagagcaagactccatctcaaaaaaaaaaaaaaaagacaaatgtcagcttatatgaaaataacattttcccttcagttgctccctagatgtggagagccctctccctcatggaggctccttctatagcccttggactggattaacatgtcctcctcctcctctccctgtacccctccctaggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgaggttctttgctccagtcctgcgggagcagggaatggggtgggggtgggggttgtaaccggggtagagcagatccttggacttttcctcaaagactgctgcttctgagtccccgagaacctcttcaaccacagctctcccttagggactgggaacaatttgacaccgtcagcattcaatatttttctaattactttaacttttttattataaaatagttaacacttatgtagaaaagtccaatagtataaaaggacagcttggcaaattattataaagtggatacttataaataccactgagtagaatattaccagctgtccagaaaccccccatggtcccttccttcctgacaatgccctctctctccctagaaattactgtcctgctttataatgtattgccatgtatgtattcctaaataatatagtttggttttacttatttttgaaactatgtagacagaatcatacacattcttttgtggctgacttctttcaagcaacattgtgattttaagactcataactagttcacatccaagcatttgggtaacaatggtgagttaagagggttcacatttgatgatttgtcctgaatatgaaccatgtttgtcttgcttttgtcctgaaattccaatacccagttttatgatggaaattttgtaaaattcaacttgaaccgctcagaagagtctaactgatgatactcatttactggggacatagtatgtgcccaagaacttgacatgcaccttctgtcttccatttagtcatcgttacctttagaaaaagctgattccgttaacaagatctttggagggaatcagcttcacaaacgtagcagtgggtgggggtcatgttggttaaccagttcacacatcagctcactaaaggaaaaaatatttctgcaaaaaatcttcacttgtcagaggggggtgcatgaaatttgagagccatgtgttatgcatccagctcttgaactggtctcagcttcagctggctgcagtgccctaggaagttactatgggaaaagtggaaatagttgaggcccagggaactgatcaggccagaggaagtggaagctcaagatcaactgtgcttattttgctgatggctgggcctaaatgccccaaccacctacttgggacaggaaatgacaggaccctctcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagcttttttgcccagtggcgtgtatggtgtttattgggggttggattgaggtggggattttagggtaggcaggcttagaagttttgggggactctttcctgttgactctctagtttggacacaggttggcatagggcataggttacttgagctctccccatggttgacttggctttggtaaacacctgtcttgttttcttctacgaaataaaatggataattacagttagttgggcgggtggggtgtcaggtcatggaaatgctgtgacataaatgcactgtgaccttggcaagtcttgcaacctgcagcgcctcaatttccgtaagagatttgaccgattgagttttcccagcgtcgacgcgcaaagattcctcgcacttggaggcccttttccaggttagatggttgctaacctcggagcagtctattttcccgccttttccgcgcccagcagcagcttcctttgcccctcccaacttccaccctgcgcgcagtcgcagatcgccgctgctgtccgtccacccgcgccccctcaaagcttcccctagcaacaagctcgggctcagagcgaaggcggggcgagcgcatgcgctgcagctctgtccaccgccagtcgtgggacagagtgccgggctcctccccttgcaagtctagctcttctccccgcctcctccggcctggggtccgcgtggcggggcgggcgcgcactcgggcttggcggctgccggtctcccaggccgcggcagtgaggagagagggcggggctgagtcctctgcgcccccgccccctttagcccggcgtccctaccgcgcctgcgcgctcccgcccggtctccatcttggaattgggaggaagagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggtgagacacggggtgcaggggcgcgggtccctgtgtctagttctgagaagaaagggtgcgcctttctgagaagctggacttgggtaggccctctcaggatggggaagcccagctgagcgagtggtcagcctctggctagccttgccttctgttgccacccccttccccttcctcttcccttcattgtgtctggttggtgggggacctcaggtgacagggtctctgatgtcaccggcgttcacaccctagggtgcttcagctaatcagatggatttgcacttcagtcttctctccttcactttgcccctcacagccacctctcctccctgatatgtcccgttctcctggctattctgtggttttgattcccatgcctctgattcccatggtgggtctgcttatctgcttttcaggcctggtctggttggatttcttgtccttgcaaggaagtgtgtgtatatgtgtttgtgtgtatgcgtgtgtgtgtgtgcttggaggtgcctggcaatgttttcccccagctgcagttaccttccaacctcttgctgtgatggtgtcaataatctcatccatttgtcaaacgatctgtcttttacaaagtgctttgacagccattctctcatgtgacatccccgcattcaccctgtgggggcctcttttattggcatcttcccattttacagttgagaacgttgaggccgagagaggttgcccaaggtcacacagtggcagaaccagaatttgaactcaagtcctcaatcacatctttccctgatgcatgcctggttcttgccatctcttttcctctgagtttgggctcggccaggggtccctaggagtccaggctggggtgaggtttaagaatggggatgagatgagcttcctttccaggagggctctactcagaagcttttcctgatgggagcctctggcttttgcctctgcctcatggagttttctatccactgtgaccttcatctttaccccaatcccagggtttggcctggattcctgagagggctctctcctgacaaatggtagcactagtggcatcttttaactgttcaagccaagctgttggggtagaatgatcccccaaaggattaaagctttgtggggaccttggaggcagggaaggaaaaatccatatgctgagtgtctgcatggtgttcctaagtatgagatctcattaaaatcttaacaacagctccatgctgtaatccatttcactgaagagaagaccaagaactggaaggaacttatttaaagccctgttgctgtacattgcagacgggatgtactggtagcatagcttaggaacagatagatacgggtttcctcatctgtagaatggagataacattgttcgttttggaaggtggttatgatttagcacagaccttggttattgttcaagtgtttgttgttattatggggaaggggacctgcatgatgttttgccagtgggtggcacccctccgtgtggcctaggttagcattctggggccttgtgttggtaaagaggtcaggaagattcctttggcaagttgagagcacctgcctttgtgtgtgggtgtgtggtgctggtgaggggtgcttggcactgttgctggcagaagggagaaaagggccggctttgagcaacctgcgagctgctgagggctgagcagagagcaatcactcagtctcccaggctattctgagccctctgcaccctgggggcccactggagagtcaggctccctccttgccctccagcttccagttgggctgagacaaaattaacaacacaacaggaaacaatgcatgacagaataaattacatgctaaaattgttaggtgcttttgagtagctagaactctgccccaggagtccagctctgctgaaggctcctttgtgcctaaattctgacaagtgcttaggctggagcctgtcttggaatctccttgagggttttggttctggtatcctgcaggaactttctccgggtgtttggttgggtgccctaggtgctcttcccaatggctggagtggtcaggacaggcttcctgcaagaggggagctgagcttggggtgacagctgagagagtaatggatacaggcctaaccggggagccgaaggtcctgttctctgaccttggagaagtcctttttcttctctgtgcctcagtgacctcacctaggaaatggtgatcatgattctgccctgcctgtttcgaagggctgctctgaaatcatagtgatggaggaccagctttggacaaggcacttaaccttgctgagcctgtttctttatctgtaagataggggaaatcatagtacttgcttcataaggttgtagtgaggactgaatagagataatgcacgtaaggtactcagtaaatgttatttgtaccctgcaaatgtcctgtacctgtgtgtgatgcttatgcagttggacaggacaagtaaggtggcccagagcacagagaggccctcatagccagatgccatttatatccctattcttcccattctagatctccccctgacttttttgagagtgactttgcgggctcctctgggccagtacccacttctaacaatggacggatttccaccgcctccggcctggccatttcctgttctcttccagggtgtgagaggttgagggaggagggggcctcagcgccaaggggaacagaaaggtgcctggaaacagttggggtataggacttatgggacaggacacttggggctctggagtgctggctgggaagcagaatgttttatccttgaggggagatacaggggctatagggaaatgagaacttgttgagcactgaagggggtggtgaggatacttagcttcccagaatcttcctagcagttttagggactccagggacccagcccgcgtgatctggttgccagggcaacttcattttttggagctttgatgttgttcctaatctccccctccccttcctcagcagtgcctcctcctcatcagggaatgaggggaggagatggcagaaacttgatgggtcccttcctctccctgaaggctcaatccttgatctctaagggtcccatttccattcctcaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgtgagttgggtcttgggagggtgtaatagggatggggactcttcctatccctgtggacttcccaacagcccttgcacactactccatcacactggtctttcctgccttctcttgctgggccagcaagtcttcccatgcccggctctcaatggggccttcaacaccttctggtctggtcctctaggcccgggatgtccggaatagtgaggtggtggccatcaagaagatgtcctacagtgggaagcagtccaatgaggtgggccaggtgcaatacagccaggttggggacaggggactcctgtctcaagatgcaagctgggtaacctctgcctaccctgaccccctagaaatggcaagacatcatcaaggaggtgcggttcttacagaagctccggcatcccaacaccattcagtaccggggctgttacctgagggagcacacggcttgggtgagctggtgccagattctggcctgatctttactcctattcatgcccgtccttatcgtagtccagtctcttaggtggtccctgttcgtggtgctgttgtgggatcttgggaaggaggaagtctcttttgaccgctttagtcctcagacatacccactgagcaaaagcctggctcagtgacacaggctgttagcaggtgggacaggtcactgtgggctggagaaggtggagattgaatgggagtttgaagggattcagatgggcagtggtgaatgtcttgggcccagactctagaaactctcccaccaccccctcattgtctccagttgcgcttcctccctgtcatcaccccggggacatagcttgagtacaggacagtcaaggaagctctgttttgagtccctgcccaggagactctgatctctgacccttgtctcttccttagctggtaatggagtattgcctgggctcagcttctgaccttctagaaggtaagtgactgataggccaataagtggagaagggagaagagcaggggagccatagggaagggttaaggggagtttattccagtcccacccttgcgctccctcgggttgatgttcttcctcactctccagtgcacaagaaaccccttcaggaggtagagatcgcagctgtgacccacggggcgcttcagggcctggcatatctgcactcccacaacatgatccataggtacaagcagcaccggcagtgcctgggaggggagtgctatctgcaccacctgtcacttagctgggctgcccctgcctagctttcttgagacacatgtctcatccctgtactttgcctctggcagggatgtgaaggctggaaacatcctgctgtcagagccagggttagtgaagctaggggactttggttctgcgtccatcatggcacctgccaactccttcgtgggcaccccatactggtgagtgagtgagtggtggtgagtggagagacctcccagggatgttgggagtaggagtgacagggtctcggcgggtgatttgcctctctctcctgaccattctcctaggatggcacccgaggtgatcctggccatggatgaggggcagtacgatggcaaagtggacgtctggtccttggggataacctgcatcgagctgggtaagaacatcctccctgttccctcatcatcttttccattctttcctgttagttcccagactccggactacccccttctcctagggatgggatcccaggcctccaagttcctgtccgttgtgactctaccctggagcccaatacaggcagctggcaaattctgccagctcttaggcctagagattttgtagcattcatctcttcctgtccactaccctggttctgaatcttttcttagtgcccaccatgtgctgtgccatggactgtgattctggagggatagcagtgaatgaaaatcctgccctcatggaacttacatttgatttagggaaaccaggcaggcatgttttctttcaatgtgatgaacgctgtgtggagaagttacaggagcggttcaaatgtaaaacaggggacttgacctagtttaggggctgaagaaggcctccttgtaggagaatattgaagccaacctgcaagataaataatagctgtttgcagaatgtagggaagagctttccaggcagagagaacagcatgtgagaggcctagaggtaagtgcaggcctggggaactgggactagcttcagttatttggaacctagcatgtaatgcagagaatattgaaggataaggccagagagttaggtccaagtgagttcctaaggccttgaagccatgccaaggttctcatctctgtcagccagcactattgaaacaattctttaatgaggtaggtaacctttataaggcttccaacacaatgccaggcacaaaacagttgcctaagagttgctgttagtttctcttatcaacagcctcctgcagtgatctctccagtctcttctcccttccagtctgtcttaagtactgatgccagagaggtctgcctaagctcagtgctgtcatttcactccctgtttggagccatgagtggccccctgttgccttcaagactgaagccatccccatccttcctcccaccaacctagaggctttgcttcgtaaatgctggccctttccttcatgggctccaccctctgagtgtgtcatgaactcttccacttccttgccttggttcgtattgggtcctctgcccgaggtcagagatttggacgagcccttctcctccatcttcacagtctccatttaccattagatgccaggcccagacagttgatgaaaaatgtaagaaacggacccaagtataagaaaaagctagatctgtccattttatttctagtttttggaagagatgtggatacagagaaatattactctactattgaaaaaaatatatatcagtctgattataaatgtcaactcatactaagtcaatatcagggaagcagtgtggagaaggatgtggcaaactggagattgctgtttccatagaaagagggcagctaatgcttatctccagaccattgttatgcagtaatgtagactccatttcaccagatttaattcttaaggagaaactggaaacttgtattattatttgattattacttttggcagttaattttaaaaatcaccgtttaggccaaaacaacatgacatttgtctgggctacaagggactcttagcgactcttagcttgcacttacctttctaatctcagggctttttacaaagcccttctctgaattccctgaagatatgctagcttgaaggctcactgcatactctcaacttcccagccacttccctgtttccctcttataccagttaatactttgatgttattttttcagtcctatttaatcttttagactggaggttccttgagggtggggcctaattcttgtttttatcttccccatagcaattatcaagttatctgctccctttggcacctaagaaatattagttggggtgataactgaatggctgtccttctgccttcgttactgcttttgtggatgttattttctttgacccctattccacccgtgtgcagtggagaggatgggtgttgtattttacagaggaaggaattaactgagacgcaacaggatgatgggaacttctcaaggtcatgtggcaaggaagtcaaggaattggggtttgaacccaagtcgtctcagttccattccattgtcctctaccccctgccacctctcaccttcttccctttcacctttttctgtagctgaacggaaaccaccgctctttaacatgaatgcgatgagtgccttataccacattgcacagaacgaatcccccgtgctccagtcaggacactggtgaggactgagattccgaatctgggcccaggcgttaggccatggggtatggatgcctgactcatgccttccccacccctctcccaccctcctgtgactttcaggtctgagtacttccggaattttgtcgactcctgtcttcagaaaatccctcaagacagaccaacctcagaggttctcctgaaggtgagggcctgctggcctagcattctcctggaactgtagcttgttacagccacaagaacccccagggaaattagtggttcccagttcctcctccaccaagagcttcgttgatgaattcccaccccatccccaatgcctagtggactctgtgttttacaagattttgtctaccagactgccttaatttattaagtaataaactgttttcccttcttttattaatcaaagatttatataattgccagccagagcttctggtcagcatgtgataaccagggttgccccactgatctgatgtaatgcaagccaaaagcctgtgtagccttatcatgggtaaatgtatgatttcccttaggtgttttttgaattatcaaaaatggaggggccccattcccttcacagacccatgggggcctgaggagccgtagttggaaacttcagattatgtagttggacccacttgttttataattgtaggatactgtatgaagcccagaggggcctcatgacatgtccaaggtcacatagccctttagtagaggagctggacgagaatccagttctcctgactgtccctgcctgtcagccatgcttagaggaagaagagtctgtctggggagtaggtactgggtggtacagaaaattgtgagagaagggcttgggataaggccagcatcaacccgtggtgggcgtgggccccagaagagtgcctcaggcctgagggaatgccaagggctgtgggttgtggggggaaggggagttggcagcagacctcagtgccctcttcccccagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggtgacccagcttgccctaacacccctctttataccccatgtgtgcctgccccctgcagttgcttggccccttccccagccctactcacaccaccatcttcccatgctacctccatgcatatgccccagggcttccccttccctgtccagcagcctacgccctgttcgcaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccggtacacagctcacccttgggggacccgagccacctgctctagaactgcctgggtcttcgccctccttccctaagtgcagcactcctctgagtctgattggctgtcctcaggtagctctctttggacccagtggcctctgagccttgggtgttccttctatctccctctagggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtgagtgtagccatcctcactcagcctgctcgctgtctgttttttaagtctttttaagtctagaaatgatttcctccctgtggcatgggattgagtctggattctaccctcattttctgttgctggctcctgcctgctccccttaaccctcctgcttccctcctcttcccagtggactgttttggtcatatggcccaatctgggtgtttctagcttggcaaactcttactccgtttttgtggcctgacttaactgacatctcctgggttgccttcccaggctcctctggtgagtcagatgcttcacagttgtgtgctggggaagcccagtgctgggggagccctgtgcctgtggagccctgtgctgggggtgtccagtgctggggagccctgtgccgggggtgccctgtgcttgggtggtcctgaacagcatcatgataggtttgccagattctgtgccccagagggcagggatggtgttcagatatctgtctcatgccagcagttagctctcaggcttacacacaggcctgtgttaaccctcccagcccccctgggaggggaagggtaagatcccattggagaaatgaggcacctgtggctcagaggggccacttgccccagtgcctttggtggctctctgctcctgtaagcaggcccttagtcctctcctaaaatcaactcatggcagtctttctcagttcacaggaaaaagtgtttaggcttttcataaaacatagtttttcatctatgtttttagatcacgttcctgctgagctgcatttgagcgtcaacaatccccttagaggccactgattaagtctagtatgttcttatggcctctgcttggtgctggttgtgttccaacaattcttcagatcccatggtgttgtgcggtactgtgctgagaggtcttgactgccaggggcttggctgccgggactagtttgagagccactcatagagtcaattgagaatgagacctgagatcagactttggatgaaggtgtccaagcccagtgttcttgttattccagcatcttgtggccccgatcccacctcaatacctggggagtgataggccgaccatgtttgctgaaggggaaggaagccaacacttattagatagagtccgaacttaccccacagcccctatgaggaggtattatttccccatttaacagatgagggaactggtgctttgagaagttaacttacttgagatcacatgcttggtaagtggcaaagctgggatttgatcccaggtatgtctgactcactgtttcaaattagtatggattgttcctacttttgtgccaggccctgtgctcgccaccttttatcattcggccacaccaacttgtgatgtagataatatcaccattatccagttgaggaaacaggctagagtggccgtgtgtgaggaaggtgttaaatgagaatgaaacccatgagttgaaaacccatgctcttccccacggaagaccccttgtgttaattaactaggggccaggctgagccccagctctcaccctctctccttccccaggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggtgagctagggctgcttgggggcggagccgatggcgagccaggtgggtcctgaccctgcttccctctgcactcgcccaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggtaggcatcccaatctctgttcccctcccgctcactcgtggatcccagggacccacccttttccattttcctcattcttgtcttctttctccttggccctcgagtgttacagttcagctttgcttcagtgccccttttacttctcatccccaacagaccctgccagaatttccttaggcctcttttcccaggccagggaggagcttgcctcccctacaccctcatctcctgccatccccagctccctctgccaaggagccctggcccctcacttccttgatactgaccaggccctgggccctgtgtttcttccgccatccccagctccctctgccaaggagccctggcctctcacttccttgatactgaccaggccccgggccctgcatttcttctgcctcaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtgcctttggcccaggctgcctctgtctgctttgtcctgccgcctagcctccccggtatgcccccaggctgaccctcggcccggctccatgacctcttcaccccatctccgttatctcagccccctcactcctccagcctcatgctctctgccttcatagcttcattgcaccatgaccaccaccggctctggggtctgggcccctgtagaacttcaccgaacttcttggtcccacagagcgcctgtttgcgggttccttccagaggtcttagtttccaggcccttggtctcctcatcccttgccttttctcccaaccatggctgcaggggaccaaattgctctcctgcatcaggcattaccctagtgggttgggggacggggctgcagaccctccacagtagggggtgctgagctgggggcaaccaggcggagtatgaaggctgtggcagcaggattgagtgtgggcctggagtgggagctgagtgtgtgaggggccgggctggaatgcggatctggtcagggtggtagctgctggccggttgaacttgtcaggccctttctggccacctcctttgcccctttctcctctgcggcccaaaatggggcagccccttcttacccatttctcagctcggtgcttctcctccttccctgccttcctccctgagctgctggacctgggacttcctgtgtctgtccttagtcgtgttgctttcttcatgggtgttttgtgtgactggttcttctcgcttgttctcgtgcacgttctcatatttgctcacgtgcttctgtctctaggtcacagtctctccctctttgcctggtcagagcttccaagatcctcagttccctgtccagtaactccgatgttctttctcgtgggtatcgcacccaactccgtgcacgtgctcttggaacctcttgtcttctctgcatctcttgcccatcgagaccttcctgatctctctcaacacgatcccacctctccatgtctgtctgtctgtatacagctccccccaccccctctgtctaacatgttttctgtttctctccctctccctgtctctgcttctgtctcctctcctcttctctctcttctccccatttcccctggttgttcctcctcttcctcttcctcctcttcctcctcctcttccccgctgcccccatctccccttgatccgtccactgcatagtctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcggtgaggcctggggtccagggagggagtgcgctagaggccaggctctgtactttgctttagagaaatggacggtgcagggcatgcacagagctggggcttttttacttgggaaactcacatactctccctctgttcgtgttctccacaatgatttatttcatattctcctcagtggttttattctttctcttagtattttcttaaggtcttgacaaagccatgtgcctattcccaagaaccaccaaggaaaagagtggctattatttttttcctgggcctgagttagtttaatgggtaaacagggtgcagattaaagtgagtgtggccctcaagcccatttactcagacttctggaggattttgaaagttgctgttctaaaaaaatgatcacacctaacactggaatgggccacttaaaatgtgcggagagggtggagagtggaaacgccccacccaaggctgttctctcacccagtcccacctctcccaggtaacttgttaataattaactgtattttgtgttttttcagtgcacattttgaaaaattatatgaattttaaacacagatggaatcatactttacatttactttctgtaacttcttttttccacttaatatttcttggacatcttcccctgtcagtacacctgtctcattttttttacagcatagaattttccatggtatggctgtaccataatttatttaacccatcccttattggtggacatttaggttgtttccagtattttgctatcacaacgcttccgtgaacacctcgagcacatgtgcaagtatacctgggggatagattctgcagtgtaattgctgtgccacagggtatgaccatcttccattctgatagatgttgagaccgctgcttcttgaaaccttagggcccaggcctacctggggcaggggaggatagtgggggtgggggaggagatccctacaactggttgttcatcttccccagctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtaaggggcccagcctccaggactggggagggagggtgggctcctgcccccgactctaacctctgttccggatgccccaggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgataggtgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacagatctcaggactcacccttctgtctttggtgtgcgtgaaggactgctcagtggccactgaatagtactgcttgtgttttataaagagaatttattgggctgtgtatctaaacatttcagtgattttaatgactttaggtgtgaccagatctcggatctcaaaggtggtcttcaaccccttgacctctaattcgttttctttgctttgacttcaaagattcttaggtttgcctcccacacagaccccaggcagctccatgctcacgaatcttcccgcaagcctcagcagccagagttcagtggagacctcatgtgactgcagaggctgggcctgtagccagaggcctagagggctaggactggcccaggaggtatgggcttttccccacccctttgaggctaacagcccatggacaaagtggctgtttgcataagggagaaggcttaagcactggctgccctcaagtcattctatccctctcccaagtgggcattaggttatcagactaggctaaaagcagaggggccacggggtaggcgggcagcacaggagccacacacccttctccaaaagggtctggtggctgttggatgacagggtctggaggcagggacttcttccaggaacccgggggaaattaaagggaaccaggccaggggaggaggtggaggcagtgactactgctcagtttcctggcccaaaatacaggaggtgagaatgggggaccaaatttgatgaggtgattaaaaacactcctttattgagtcttaaaaaataaacaccttaaagggacagcgtgaagctgagaagtagcatcccaacagcttgtgtccttgggagctgcagtcttctctgaaggaagctgcttctgttccacagacacagggcaaggggtgctatgtatgctttgtacatgtatcaagggtccctcctgggggtggcagagctcagttactctcgccatcactgctgatgatgccacgcatatgtgaccagtctgggggtgcgggacggggccgctcttcatctgagtccagggtccgtcggtacagctcccctgggggtgctgcttctcctaaagggttccaggctgtacgtctgcgtggccggcctaggggaaaggggaaacgagagatcagatgtctgagaaggtccaaccccacctatctgctcctgggcagtgagaggaaaccccttacccgagccactgatgatgttcgcaacatccaaggaggccacctcagctgcctcctccctctgctccttcagggcccgacacttccctagggaaggggtacctggggcagaagaagctggtgattctctcctccccagcaggaaggccctctcctgcagcccccagggcacgccgggcctcacccttcatgcctagcgcttccagttctgcccggaggatactcaggcgctccttgtgtgagcaacaggagcccaacagcttcttgtagtttcgatgggcaccacaggcccgaatgtagcgcttcagcctcatcacagccgggtggtcctctccacggcgacctgagccagcctagcaaggaaagagcagctgaaggccaagcctgctgggcctgaggcagggtctccctcttccctaatagtggcctcccacccctcctcaccctcaccttccctcctttggcctctggacttccatctgaggaggaagaggagcttcgtgtcctgcctttcctggagctcttcttggaagagcggttcttcctctccccctgggggcctccccctgcctcgctgtcacttacctccctctccaagtcactttcctcaccactggtgctgcccagtctggccatctttctagagcctttagctgtgggttcccccttcccactgtcttcctcgtcctcgctgcttccactcaacctcttcccacccttaagctgggtcctgtcctcactcttcctctgcactgggggttctctatctctcccactgtcatccccactgctggctgcctctttctgctcttcctcgctgtctgagtctcccaagagcctctttgcctggcttttctgcttacagctcctctcctccctagctgactttctccggccattgctcctggttctgggtttccaatcccccttttcctcatcctcttctttctcttcctcctccacttcctcctctctctgctctttcttctgggctaggatctcctcttcactctcctgttcactttccttcaggcttttagttcctttatttccctccaccttctttgctgtcctctgaacgggttctgcctcgctctcctcactttcttccctggcctgcttcctactgactgaggccttgcctggtgcctgcttctttaccacaggtttcttcctagtcttccccttgtaccccttttcctcctcctcactgctctcctctcccctctgtgcgggcaggtccctctgccgttcctcatcactgctctcctcaactgcctttgaggctcgccttggattctcctctttggctgggctgacttctgctgccaccccattctttgctgggggtccaaagtagtctgggctggaggcttcagagccggactctggaatatggagaggagagagggttgagacaggctcctcctgtcccttctcccttcacttcggataggttgcctcgagccctgccctgacagttggaggggcagcaggaaacagctatctgtacttgctgttcccggttcctgactcactagccttgctccctcatctaacgcctggggacataagagatgcgcagtgaatgcttcttgagtgaaccaacgatgcagaaggcccccacagcagggaggaagcactaacccgactctgaattgaagcggaacctttttctctccgggtcgctacaaggggtgggaggcctcttgcccttcttggtaaggtccagtttgtcttccctggaagcggcttcatccacctgtgtgtgcgccaagagggcaaactatgcaccaaggctgcgctcaccgcgccccgtcaggcccctcctcctcagcagcaagccccgcctccgcctcccgcggcccaggctccggcccggcacacctgcatcttcagcagctcctcctccaccagccgcttcagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgtgagtgctgccgcgggaaggctgtgggggatgaggcctggcgcggacaagatctcagtttacccaggtgtaaagtgggtggggcgagcggccgctggttccggggcccttcacggaggaccgttggcccagcgcaccccttgcccgtgatacaggagcacgagtgcttccaggaggagctgaggaaagcgcaaaggaaattactgaaggtgtcccgggacaagaggtgaggcacgttgcaggggcggagggcgatgtgcttcctaggaaatctacattcggaccccatccccgagtagggccacaagtgcatgggctctttcaagtatccgatgggccagctgggagggacaggtacccaggaggacattgctgcgctggaaaatcactgtccgtgtctccttccctcccctcagtttcctcctagaccgacttctgcagtacgagaacgtggatgaagactcttcgggtgagcaaggtcttcaaaaattggtggagagcatggttcctggtacttagcaagcttcctgggcccccgccttttaggcagtggtggctgatgcagcccccagtggtccttaagcctagttgcttgccttccacctccaccgttctttcattcaggcacttactgagcacctattgtgtttcaggcactgtgcttggcacaggggatacagcagaggcagagataggcaaagcccttggcctcttgtaatttatattctagttgggaagaataagtaaatgaagacaatagactagaattttaggtcataggaaggacttgaaggtaatgaaaacagttatgcggtaatgattatagtagaacaggggttgatgaattgtttctgcaaagggccagatggtaagtaagctttttgcaacatacaatctttgaagcacctactgaactctgccattgtagtagcagccgtaccccataggcaaatacatgagtatggctatgtttctataaaactttataggcactgaaatttgaatttcatatttttccatatgaaaaatttttctttagttttttttttttccaaccgtttaaaagcttaaaagccattcttggccaggtgcagtggcccacgcctgtaatcccaacactttgggaggccgaggtgggcggatcacaaggtcgggagttcaagaccagcctgaccaacatggtgaaacctcgtctctactaaagatacaaaaattagtcgggtgtggtggcgtgcacctgtaatcccagctactggggaggctgaggcaggagaatcatttgaaccctggaggcagaggttgcagtgagccgagatcgctgccactgcattccagcctgggtgacagggcgagactccgtctcaaaaaaaaaaaaaaacgcccttcttagcttgcagaccacacaagcaggcagcaggcaacctctgaatggagtactcaagaaaggcctttcacagagtgacatttgagttgggaccagagaagaaaccagccttccatcctgggcaacatagtgagaccccatctcaattaaaaaaaaattagccatgtatagtggtgtatacatgtggtcccagctacttgggaggcagaaccaggaggatcccttgcctgaaaggtcaaggctgcagtgagccatgatagcaccgctgtgctccagcctgggtgacagagcaagactgtctcaaaagaaagaaaccccatcctggctaacacagtgaaaccctgtctctactaaaaatacaaaaagttagccggggatgttggtgggcacctgtagtcccagttactcgggaggctgaggcagaagaatggcgtgaacctgggaggtggagcttgcagtgagctgagattgcactactgcagtccagcctgggcaacagagccagactccatctcaaaaaaaaaaaaaaaacaaaaaccaatcttgtgaagaagtgggctagagctgtcccggcagaataatataaatgcagctaccctgaggtaagaacaggtcaggcttggttgaagagcagaggcatgaaagagagagaacactgttttcgtccttttatttgaatattgtctgcagttaactatattttacatcataaccagggccccacatgttaaacaaaacaaagtttaacgaaacatttttaagatcactgtatccaattcatcctgacactttttagactgcttttttccccttcttttaatgctggttgcaaaccaataaattgatttcatgacccactaatggcttgagacccacagtttgaaaaagccctaaggtaggcatttgtgggcctcttcctgggtgaggccctcgtaagccatgtcacgtagaatcacctctctccgtggtgcctttaaacattggtctgggccgggcacggtggctcacgcttgtaatcccagcactttgggaggccgaggcaggcagatcacgaggtcaggagatcgagaccgtcctggctaacatggtgaaaccccgtctctactaaaaatacataaaattagctgggtgtggtggcgggcgcctgtagtcccagctactcaggaggctgaggcagaagaatggtgtgaacccgggaggcggagcttgcagtgagccgagattacgccactgcactccagcctgggcaacagagcaagactccgtctcaaaaaaaaaaaaaagcacattggtctgaggcagggattggcatgtggcagccagccacgttttaggacgtagtgttttgtcagaacgcatgatacccatttgcttgttattataggaggattgtagataaggttggggaaataggcaggggcccactcaggtaggtcatagtaggagatttggcttttattgtagcctctcatcccctgcctcttccttccctaggggcttccagttaacatcctgtttgaggggaattcagggcaggaggtgggagagaacccagcatgttcatggccagagtgggttgcatctgaggaggaagagccagcgatgcgagccccactcccgtcctggaggcccacgccctggccagggagacactcgcaaacgacgcttttcagcacagtgtgagggcagccatgacgagagtagagcgttccaggagagcctgcagttaactgggcttgagggattctggaagacttcacagaggaggtggcatttaatctgcttcttaaagggtctgtctgagcagagacattggtaacggcttctataggtgtagcagtcgtttgttcgatgaaagatggcccttctaggcagaggcactgaactaggaaatacatttcttttttgacgaaataggtcagtgtgctttaaagaatacagttacgttagttgaccagaaaggtacattgaagccagattaagcagcaccatgaattcatgcaggtagtgggtgatgtcatcaggaaggatgtgaccaggtttgttttaggtcactctggggttgggggtggacagtgggtggcacggtgaggtgagactgcttagcaggtgattttgacgtgctggtggcctgacctgtgttagttggtgtggggagcagtggatgaaggggaggacttcaggggtagatgaacaggaccctggttatggggagtggggcagaggcaggagttgaagactgctcagctcagaggcaaggaaccagtggcatcaaacagccaaggagtcacagacctggcttggagtcttagcctcacaccttactttctgagcctcggtgacctcatgtgacaagtggaggtgctgcccttcccatccttccttggatctgatgacaaggagaggtggtgagtgggaaagagcctggcaccctggccatgcgtggcaggtgtgttacggaggaaccagagcgggcggggggctggggaggctggagaggctatgggcctccctgggacagctcgagtgtgtggtgcatgcgtgtgcccaccagctggtgagtcagattcccccggggcccttctgttaggttttggtttgtttcatttttttgaggcagggtcttgctctgtcacccaggctggcgtgcagtgttaaaatcacagctcactgcagtctcaatctccgagtagttctcctgcctcagcctcctgagtagctgggactacaagcacacgccaccatgctcggataattgtttttgtttttaatagagatgaggtcttgctaggttgtccaggctgctcttgaactcctggcctcaagcgatctggccacctcagcctctcacagtgctgggattccaggcgtgagcccccgcacctggtcttccagtgcccttctgtagtgtagaggaggttatacctttctgggatggactgggatccccccatccccactgaccagctgtccccatcacagactcagatgccactgcatcatcagataacagcgagacggaggggacacccaagttgtctgacacaccggcccctaagaggtgagaagaagatgcattcctctcgctggggagggtcaggtggggcgcctgggctcctagccacatctgacctcgccctgtcctttctccaggaagagaagccctccgctggggggcgccccctctccctccagcctctccctgcctccttcaacagggtttccccttcaggcctccggggtcccctccccatacctgagctcggtgagttggggtcagggatgggaagtgcttgggagtaaggtgggcgtcatttgggcagaagggctgggcctcggggcaaggccagcccaactttggggacatctgtctgggtgtggcccaagtgtcccgtggagggtgtgagtcggggctgcccccttctctctggtataggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaaggtaccctgacgtgggggtgctagggaggggcaggacggcaggaggacagtcacctgagggaggctgaaggcgggggcctgtcagagaaccatgaacagttaatttggggacccagtcagcacttagcactgaggggtggatcacagaagtctcggcttacaggcttgtatggagacaaatcagggcagaaccagccttggaggacccggtgtgcagatgccagggatcccgccctttcatggctgcagtgtagcggggccaggctcattttcccaggggggcgtgttgtgtgatgccaggtagccccagaccgggtcaggattatgggatctagagtcaagtcaagactgcctgttagaaaccacgtggccttgagcaggtctctgctaccctctaggcctcctaggcttggcacctatagggcgagtggtcctactcgatgtgaccagcaagcgcccctggagcgcctcctgttacacggcagtgcacaaagcagaccagtgcctgccctcacagagctcacagtctagcaagataggcagaaaacacaccagaaaagtaggtacttgtggagaagaacagagcgaggtccagagcatggggacgccagggggacgaggctgacacttagggcccagcagtctgggatgttcttgatcagagacttacaggaaatggcagcaagctgtgtggctcctgggcagtgtttctgtcgggcagagtctgtgtttgggagaaaagtaagcagggaattgggtcccggagcaggtcagagggggagctcatgaggtgccagtgtgcaggattcgctgtgaatgaagccttggagacagcagttccctggcggggcgcaggttgcaggtgtggagggggagtgatctaattgcatcttaacaaaattgcagacactggtggtcagagaacagactgagcggtggagtgagttgggacgggagtgaggaggccaccacggtaaaccaggccaagggcagagggtccagagggagctgcggacccatttcagagaatgagcatgggagttcctggaggacctggtgtgggctgtgcgggagagaggccaggatgcctccagggctttagtctgagcacgagtggagtctccctccctggagatgggagggctgtgggaccacaggcttggaggaaaactgagtctggccgcggatgtgtcagatgccatctggaaaggcagctagatagcggcccgtgaggggctgcgcatttggaagccgccaggctggcggtagatgcaagccttgggagagatggggatgggctgaggggcagagcggagtggggaccaactgggcggctcccagggttctggagccagaagcagaatgagaggccgcatttgcggtggtctggagtacaggatctggagctctaatcccaactctgccgttttctccgtgtgaccttggccctgtgaggcttcacctcttgagcctgagaagcagaggtgacagtactggccctggttcttagcaggggggtggcgggcagggtagggggtggcgcagcactggggggcactttgaggctttctggctgggtgctgagtcctgaagcagagtcatgtccgggagcaaagttgtagacattctggagagaaggtttgagagggtggcccaggtccatggctgtcgggggaggtggggagaagccaggaaaggcctcagcaaggagaacgtgtaagcccagggtgagtggatttggatattcctggctgaagccatagtgggaagggagacagggccacagggaaagcactgcctgggccagagcaggagtggtaagaaattggcaagaagaaccgggtggggtggggtcatggaaggcctggacagtggcctgaagtgggaatttgtctgttactgtcaggggagcgggagtccctgaagggccaggggagtgaggagatggaaggaagggagtccaagcagaggaaggatagctgtgaagacagaagcaggttggttctgtcaggcctgagttggacttggccagctttgaatcccagctcttccagtgctcaccatgcgacctcagcgttgtcatttcactctttaagccacagctctctttctccattcagtggcggcattgtgcggagaatgtgagtgaagggatgaaaatcgctcggcccgtgcctggcccctagtaagccacagagaaatgtgagccgctgccagtcaggctgagaggacgccactgaggaagtccaggccagggtgggacatgctgcgcacagtggggaaggagaggaggtggccagaggaggggatggtcctttccagtcatacacgcatgtctgcttgtgtgtgtacatgtgggggcctggtgcagggcgtgggggtgctgttcagagttggaccccccatcatccatcctgccagcctcctataccctgaggcctgacccaccctggcccccacaccaccccagcagcggagatgagggtaagtgagggctccttaggaagcagagaggaggccacagggccaaatgtgacactcagaagggccactggagaccacgcatggcgtttcctgccagcccactcagcatctagcccagggccagactggacactgccccgcaggacccagcaggcctaagcctcaggacctccatgtccacaccaggttcagcctcctctgctggcacgtgacttctccccgtttcccgccccccagtgtcctgaggctgggagggcattaacagaaaccacctgacacacagcaggtgcccagtttgtgcccacagacaaagcacggggactgcagaggagacccacagagctctctagggagggtttgtgaggacctggcagcgggggggagctgaagggttgagcagggcagaggccacttcccaccctcagaggacaaagcaggacttctgacaaatagagcaggatgcccagggggaggggctgcctgtcgtcccgcaggcggcactcccgccccgaggccccgagtggcacggtgacgcgctcaggtctgtgttttagagcgcgcgctctggctgccgtgcggaggagctggatctgggagaggctgcgggcagggagtccagttaggaggctgggaccgcagcccaggtgagctaagaggagggctgggcctaggccacagctgccgggaccccgaggaggggcccatccaagacataatacaagcttcttgggggcagataagccgctggggctcctggctcaggcagcctgcaataccctccaccgaaccagtgagtgccgcagaagagggagaggaggagtagggagaggaagctggtggcaggtggcacctccggggccggcaggcaggcaagcactccaggccgactccgcctctggcttaacccctgtctcagggcagcccaggcgcctccctggagagggcaggtgcccgggcctttccctcccggtttcctgtgagacacccccatcccctcatctcacctctatcaccacccccaggcacttgctggtttgaggctctcgaggggctgaggggggcaggccctgagtgcagcatgggttggcccagctgtgcccagggcctcttccccctccccagagctgccctggggggcaaagcctagtctcctgaggccccagtgcctccctgactagtccccctgtgtttcttccccctgctgcagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgggtttgttttttgtcctttttttttgagacattctcctcctctgaacctcccctaatccgacctcctccctgttgggggagagggacggggcagcgtggagaggcaggagtgaggagcgcgggggcctggggccgggctctgagcactgcccgggtgtgcagatgatggggggtttgcatatttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagcaggtgggcagggtcagggccacctccctgccacttgcccgccctcaacacccgcagccagctcctccctcaccaatgaagtcattggatttgccaatgtcatagtcccagacggtgacttccagggtcttggtggccagagtggagagctctatctcgtagaaaaactcctagggacaaggccggccacccgttcgtgagccagctccccagcccctccctggcctccctccatgtcccgtcccctcctgggtacctcgttaaattctgggttgagagtcttcttcttcacacacgtcttatgcttggatttcttgtccacatcgggcctcaggtacctgggggtggggtggagggagacgaactgaggggtgagggacaggccaggcccaactcaggccagggcaggctccctggggaggagagggtcagagcaagggctcacgtcttgacgtaggggtccgagtaaccgttgacgtccatggcagccagatgggcgcagcgcaagatgcctaccagcagtccccggcgccgcgagctgtagctgagactcagcaggatgcggccacgctcctccagcagcccctgcccctgctccgcctgctccaactgcggggcacagactcagggtcagcctgggcccctgcagcctcccacccacatgcatccccatccccatgaggtgcctcacctccttcagataacaggagatgcccctcagcgccgctgacatggaagagggggacgccagctgagggggcaaagagaaggttctggaagcctggcctccccagggccccctcccctggcgcccctgcagcccccacacagaccgggacctggcgctcgaggcagatgttaaaatgcttcttctgcgaaggcttgaggcggcggaggggcacgcggatctccccaataaactcattgtgactcagcttgtcctcatcacagacggcgatcctggtcgggaactgcagtgtcagggcccctggggtacctgagccccgttccggggtgtaggaagggccttggaccagcccagctctgccctaaacactacgtctcatctggaagacaggctggcacttgagaaggacaagcagatttgcccattcctctgtccctccctctgcagccacccggctgtccctggtccatcaggacatgctcagccattgtgggaagccctcagaaatcttggagcacgctgctcactgcctccattcagggcctgggggcaggagccgaacaccacggtggatgtggccatagacacaggccgtgagagctagaagggccttggagccttgggcagccagaccagtaccccacgcctcctcgggaacccccgtccttttcctgcatgcagcagagagccagccccgcagggactcactaagaaatgattgctttccagccacctgtcctcctgcagtccctgccctgcctccgcagtgacccactaccaggctgggcatctgtggcatggaggatgggcagatcccagccctgccacttctgagccacctgtgtgaccttgggcaagtcacttgatcaccctatgcctcaattcccatctgtaaatggagatagtcaagggaaagaaagaaatgtgaaaatgctaagcctgggctgggccctggtgagcgctcattttttggtctcattctggttttggcctctggcctcccctccattccacccgaatagctgaaaccaaggtggcctctctgctgcacagccctgaccatcagggaaggtcccagctgcaaatccaagcacaaaggcagaggtctctccagagcctgggtttcgctgcccgccacctgacttgagggagtactctccctacatctccatctcctaggatgacggagcaagttccctgtccctgaagacttcactccttaagagattttaggggaactcaaggcacggaaggggcagaccaaagctgcagaggtctggcttaagccaagggctctgagaaggggtctcggcaacccaggaacgtttttgggagggggcagagcttggactgaacctcagatgagcggaatttaggctggcaggaaggagctttccagatagaaaacaacaggaaaagttcaggagttgtggaactggccagttggaagaagggagtcctctgtttgaggggcagaagatacttttgttttgtttttgagatggagtctccatcacccaggctggagtgcagtggtgcgatctcggctcactgcaacctctgcctcccgggttcaagtgatcctcctgcctcagcctctcgagtagctgggatttacaggtacatgccaccacgcccggctaatttttgtatttttagtagagacgggggtttcaccaagttggccaggctggtcttgaactcctgacctcaagtgatccgcccacctcggcctcccaaagtgctgggattacaggtgtgagccaccacacctggcaggcaggagatattgaggggcaggaatggcagggaagaattttggcctgctgccaaaggggctagggagccgctgatggttcttgagcatcagagaggtacgggcttaatgggacatagatcaaccaaccagcggttacaatgtcagctgtccccgagctgctgctgggtggtggggaggggggccctcacctgagcaccttgtgcgtgatgtcgtcatctgtgatcccgctgtaagtcaggtcctcattccacacgggattcagtgtgttcctctgagtcttcgtttttagcttattggcctgggatgtggggatgaaaggttctcaatacctgtcctccagccccacaggctggagtcatgggctgggccgggcggggcgagaggaggctgttaccttacaggctccaggcagcaagtgcagcttgacgtaggggtcggcgaggccattgaaatccatgggcttgaggccctggagaggagggcaggggagagggctagaggctcccggcacctctctccatccctcttgtagagctggaccctggaggagcccagaaggagggggcaagggcaggacgaaggagcaggcctgggaagggaaggaggaatgggccccctctgggggctgcacgcaaaccgggcccgggcttgggtggcagggagtgcccaccttggccctgaggatgctacagtgcagagtgcaggaggcccggtcgtagagaaggtcaaactccagcgtgcctagggcggctggagagagaggaaaggcagcatgggtcggtatggagacaggtgtgtgcgagaggccagcaggtgggcactggctctgtgtgtctctctctcttgccagcccgcgagtgtgagtgcaagaggctgagtgggcccatgcgtgtgtgcgtctgggtccctggctcggccgcaactggggctgtgtgggtggtggagtgtctcagcagaaatactgaatattgagccttgctgaagctgtaatctccacgctgactgcagctgtggtggccgtccctgccacccccccactgccctcctcccctacctacatgcacagccagcagggcccatccccctctccccccaccacggcaagcctggagacccccaccagcacatggggcctccaagcccccagactcactggcatcatccgagtcatagctgtccacctccgcaccatcctcaggcgtggtggccccaaggagggctgcagggggggccagagccagggggaccagatgggcgggggcctccccgccgcccccgccgcccccttcaggtcctggtccccgggggaagtagtcagagatctggcggatgggccggatgggcccggggcacacgttgatggccatgtgctcctggatgttgatggtcatgcgatcgcccctgcggcccctcatgcagcacccctggctaggagagggcgtgtgagccagtgagcccatcatacctagccatcctggctgagggccaggcgacggcctcctcggtctgtggggccctcactggcctcccttcctaggtgtcgagggagagggtggtgtgtgccagccggtggcaggtgggaggcctgggccctgcagaccccaagctgactccacaggggctgggctgccaacccactccttgcagaagtcgaggttgcaccaccccgtcctcacccacccacttctaggttgtccctgtatcatcttgccagctccttcctctcctccggggctcccctctgctcctgagcctgcctgtcccccaaggggccctgcagggccccgcctctgtttctcggaggctctgtcctcctctgcaccaggcgctggtctagtcagggtgtcacccacccctctaggctccaactgcccactgtcccctcattcagccccaggacctgtctgcctgcctggttcccccgctcgctcaccacagcccacggtggagaccccagcctcagatgccacctctggctcctcaggggagccagaaattgcagccgcaggagagccgaacacccccgtagcgcacacaggctggcacgcttccccgcaccctcacgcccccggcctgcccagccccctgcacctgcctctgcctccaacaggtgcccaggcactggggggacggcgggcgcaggctgggcggcggcggccggcgaggagagcgcggagtcgagctgtgcgagccgagagggagggagcgccgagaaagtgcggggaggagggggtgagcgaggtggaggcgaggatgcagccggcgcggcggcgggggacggggaggggcgctggggctggggagggggcgggatctcggactcccacccggggcccgctcgggagcgcacgcgagcgcgcacacacacgtgtgctcgcgcgcgcacactcacgcaggggcacgcggaccggcacacactcgtgtgcacacatccaaccgggcacccccgcgcgcacacgcccgtgcccacgtgtgcacgctcacacccttgcacacacccaggcgcgcgctggcacacttacccggagaacttcgcacacacacgcactcgcaaacacgcgggctccctgcgccaccaggaagcagccgccagaatcgccgggtgttccccaactactcctgggagacctggccccccgcccccgcccgcgcgcgcggccacggcgcctccctccctcccgggtccccaaggccggaccaccggcctcgttgtcatggcgacgccggctcatctccccccacccccgcgcgtcttcacgcccctcccccgcagggagctggggcctccctcctcccttccccacgtccgtagggacccacaggttgacaggagcagggggtcgcctgctgtcaccggccggggatctcggggtctcccgagccaggctggggagcctcacgatctgagggaggaggcagaggtctgatgctgcggcttcccccacgccccctccctttggccgttcaggcctctctccttgtggcccaacccaactcccaggggcccatgtccccttaccagggatggtatctcctttgggaaccaccctcccccctgccatccccagttctgccccgcaggtgggaaggggcgtcggggcttggctctgaaggtctcagagccctgcggtagttccccatgggctgccatttctcacccaaaccttgccacccccaagccgcccccctgcccggccctgcgcctgccacggagtgtcagtccacccctggccttcggtcttcactcacctgtgccccaaacttaccatcccgaagacacgaaggggcttatcaccctcgctgcccaccactgactcacccaaccgtttcctgcagttcctgggacacacctagacggctcaggcctagggatcttggctcacatgcgctcctctacctgggaaccgcgcttccttaggaagtcaccgtgggtcccctcttcctaggagccttcctggggcatcccgcactgcccctcagctccagcgccgtcaggactcggctcagcaccgcttcgccagtgcctcccccaccagcagggagttccactggagcggctgattcatctgggagtccctaatgtcccaaactgggcctggcacgaagtcggcatctctaagtgctgttatttaaaacagcaatctggttgcacgacaactgaacatacctaacaccacctaatcttacccttaaaaatggtgaagatggtacatttcgatatgcgtatttcacggcaatttttttttttttaaataagagaaatggggccgagagtggtggcgggtgcctgtaatcctagctactccagggactgcggcgagaggatcgcttgagtgaagccagcctgggcaacacagtgagacacagtctcttaaaaaaaaaaaaaaaaaaaagtaagagaaatgtaaagtcaacaacactgagggggcggggcgcagtggctcacgcctgtaatcccagcgctttgggaggccgaggtgggtggatcacctgaggtcaggagtttgagactagcctggccaacatggtgaaaccccatctctgctaaaaatgccgggcgtggtggtatgtgtcttgggaggctgaggcaggaggatcgcttgaacccgggaggcggaggttgcagtgagctgagatcgtgccactgcactccagcctgggctgtaagagcaaaactcagtctcaaaacaaacaaacaaacaaacaaacaaaaaaccctgagatatcacttattacccataaaatgggcaaagccaaagtgtctgggctggggggaagctgagacggactgatcccttgagctcagaagttcaagaccagcctgggcaacatggtgaggccctgtctctacaaaaaaaaaaaaaaaaaaaaaaaaaaaatccaggcatagtggtgtgtgcctgtggtcccagctactcaagaggctgaggtgggaggatctctcttctttttttttcttttcttttttttttttttgagatggagtctcgctctgtcgcccaggctggagtgcagtggcgtgatctcggctcactgcaagctccacctcccaggttcatgccattctcctgcctcagcctcccgggtagctgggactacaggtgcccgcctccacgcctgactaatttttttgtatttttaatagagatggggtttcaccttcttagccaagatggtctcgatctcctgacctcgtgatggtgggaggatctcttgagcccagaaggtcaaggctgcagtaagctataatcactccactgcactccagcctgggtaacagagtgagaccctgtctcaaaaaaaaaaaaaaaaaaaaaaaatccttagacccagaaattccacttttaggattttatcttacagatatgccaacccataagccaaataatagaagttcaaattctttttttctttttttttttttgagacagactttcactcttgttgcccaggctggagtgcaatggtgcgatcttggctcaccgcaacctctgcctcctgggttcaagcaattctcctgcctcagcctcccaagtagctgggattacaggggcgcacgccccacacttggctaagtttttgtatttttagtagagacggtgtttcaccatcttagccccgctggtcttgaactcctgacctcatgatccgcctgcttcggtctcccaaagtgctgggattacagctgtgagccaccgcgcctggccatgaagttcaaaattcttaaatgtagcacgttccaaaagactggaaacaactgagatacccagaagcaggggaccagttaaatcagtcatgatgtaattccatgcagtgaaatagggtgcagccacaagaggctgttttgctcttgtttagaatcatctttttttttttttttaaatatacaaggtctcactactttgcccaagctggtctcaaattcctggactcaagcaatcctcccgcttcggcctcccaaagtcctgggattacaggcgtgcgccactgtgcctggccctagaatcatttcacagtttcattttaacttagaaaagccaagtgcaggccaggcgccatggctcacgcctgtaatcccagcattttgggaggccaaggcgggtggatcacgaggtcaggagatcgagaccatcttgtctaacacggtgaaaccccatctctactaaaaatacaaaaaattagctgggcgtggaggcgggcaactgtagtcccagctgcttgggaggctgaggcaggagaatggcatgaacccaggaggtagagcttgcagtgagccgagattgcgccactgcactccagcctgggcgacagaacgagactccatctcaaagaaaaaaaaagcaaagtgcaggctgggcatggtggcttacacctgtaatccccgcaatttgggaggccgaggcgggaggatcacgaggtcaggagttcaagatcagcctagccaacatgctgaaacgctgtctctattaaaattacaaaaattagctgggcatgttggcgggcacctgtaatcttgggaggctgaggcaggagaattgcttgaacctgggaggcggaggttgcagtgagccgagatcatgccactgcactccagcctgggcaacagaacaagactccatctcagaagaaaaagaaaaaagaaaaaaaaatcaaaaaagaaaagcaagtgcagagaagcatgcttggaatactgccatttgagagggaaagagcttagccgtgtttgcttagttgttcatatgttgtttctggaggcctgcacaagaatggtaactgtgtctcttgacaagctgagagagtgaaaaaataaaaataataataaaaaaataataaatacacagaagaaaatataactatggtgacctctggggagacagggcaggaagaggaaagacttacttttcaacgtacatccttttgtattttttgaattttgtgccacatgcataggttacctgttccaaagaatacattaaaataataaattttggtatttctttgtttgtttgtttgtttgtttgtttttgagatggagtctcgctctgtcacccaggctagagtgcaattgctcgatcgcggctcaccgcaacctccgcctctcgggttcaagtgattctcccgcgtcacactcctgagtagctgggattacaggcacccgccatcatgctcggctaatttttttgtatttttgtagagatgggttttcaccatgttggccaggctgatcttgaactcctgacctcaggtgatccgcctgcctcggcctcccaaagtgctgagattacaggcatgagccactgtgcctggccaaattttggtcttgtctttttctttcttttcttctttccttccttccttccttcctttcttccttccttctttccttcctttttctttttttttttttttttgagacagggtctcactgtgttgcctaggctggagtgcagtggcaagatcatagctcacgacatcctcgaactcttgggctcaggcgatcctcccactttagcctcccatgtagctgggactataggtatgcaccaccatgcctggctaatctgtttttgtttgtttgtttgttttgtagagatgggtcttactatggtgcccaggctggtttcaaactcctggcctcaagccatcctcctaccttggcctcccaaagtgctgggattacaggtgtgagccaaagaccatgcccagcacaataatatatatatatatatatatatatatatatatatatttttttttttttttttttttttagacagagtctcgctctgttgcccaggctggaatgcagtggcacgatcttggctcactgcaacctccacctcccaggttcaagcctcagcctcccaagtagctgggattacaggtgcacaccaccatgcctggctaattgttgtatttttagtggagatagggtttcaccatgttggccaggctggtctcgaactcctgacctcaagtgatctgcctgccttggcctcccaaagtgctgggattacaggcatgagccactgcacccggccaatatttctaaagtaaaggcaaccgttaggtttccttcgtggctctccagaataagaaaggaagcaggacgaagggagacacagtgcagtgtgaaagccggtgagtttagcaagagggtgtccatgacctgggcgcagggggcctgcagtgaggggagggggacactctggtcaaggaacctgtcgagtcctctctcctgtgctctcttcccacggtgcttgctcaaccccagccctgcctgcctccagaagaacttgttgaagacaggtaaggatgaggctggagttcaagccaatttcagaggaaaatgatggacagtgctgagccctgctttgtccagagacgggaggcttttgcaccagtcacccagtcattcagtaaatattgactgaatatcgactatagattgtggggatacaaccaggcccaaggtcaatgagctgtgacttcacagcctcatagggaagacagacaaatacacagacaatccccatccagggaaactgacgtggggacaggggatggtcagaagccatgggaactcagggtcctatgaggtaggagggaacaaagattaacacctcacttcccagaaaaggagttgtctcaactgagacctgaaagatgaggaggagttacccaggtcaagcttgggggcaagtgtattctaggcagaggtgtgtgccaaagctgggaggcagtccagagtacggcatattcagaaaagaaatcattctaccagcctggtcaacatgacgaaaccctgtctaaaaaaaaaaattagccaggagtggtggtgtgcacttgtagtcccagctactcgggaggctgaggcaggatgatcgcttgagcccaggagtttgaggctgcagtgagccaagatcaagccactgtactccagcctgagtgacagagtgagaccctgtctcaaaaaaaaaaaaaaagagaaaaagaaagaaagaaatcattccaccaaaaagacacctgcacttgtgtgtttattgcagcactgttcacaataggaaagacacagaatcaatctaggtgcccaccaacagtggactggataaagaaaatgtgatatgtatatgccatggaatactatgcagccataaaaaagaatgaaattatatcccttgcagcaacatggatgcagctggaggccattatcctaactgaattaatgcggaaacagaaaatcaaataccacatgttctcgtaagtgggagctaaacattgggtacctatggacataaagatgagaataacagacactggggactccaaaaaaggggagggagggaaagagtcgaaaaactacctattgccgggtgcggtggctcatgcctgtaatcccagcactttgggaggccaaggtgggcggattgcttgaggccaggagtttgagaccagcctggccaacatggcgaaaccccatctctactaaaaatacaaaaataattaagtgggcttggtggcatgcgtctgtaatcccagctactcaggaggctgaggcacaagaatcacttgaacctgggaggtggaggttgcaatgagctgagatcgtgccactgcactccagcctgggcaacagagtgggactctgtctccggaaaaaaaaaaaaaaaagaaagaaaagaaaattgaggctgggcgctgtaatcccagcactttgggaggccaaggcaggaggatcccttgagccccggagttcaagaccagcctgggcaacatagtgaaatcctatttctaccaaaaaaaaaaaaaaaaaaaaaaaaaacttagctgggcatgatgacttgatgatgcagtcccagctacttgggaggctgaggagagaggattgcttgagcctgggaggtcgatgctgcagtgagctatgattgcaccactgcactccagcctgggcaacagagtgagatgctgtctcaaaaaaaaaaaaaaagaaagaaagaaaattgaaccaacagatctttttattcttatcttttacagatgggattctctgtcacccagcttggagtgtagcagcacgatcatggctcacttcaaccttgaactcctggcctccagtgatcctcccacctcggcttcccaaatttctcggattacaggcatgagcccccgaacctggcctaacaggtctcaatttggggttcattaggtgagagataaggaagcaggatgattcctaggtttctgtgttgagcagaccatctagaggaatgatgggaccatccactgagacgaaaagatgggagcagagcaggtctggagtaggactccatttgtgatccattgccttggagatgtatttggacatcacaaacagacatctcggagtctggagctccaaggagaggtctgggctggaaatatacatttgtgagtcactggcatatagatggtatttaaagccacgagtatggatgagatcacctaggcagagaatatagatagcaagacaaggccccatgctgagttggctggagaaggagtcctgagaactggtgagtgtggttccagggctctgagtcagggacaggtgcacctgctgggaggcagacggaatggaaagagagagaaccatttgatttggcagattatgagctcttttgtggacttgatcaaagcagcttcagtggattggtggggactaagccagattagaagaggttgaagaattggctgggcgaggtgactcatgcctgtaatcccagcactttgggaggcagaggcaggcagatcacctgaggtcaggagtttgagaccagcttggccaacgtggtgaaaccccatctctactaaaaattaaaaaattagctgggtgtggtggtgggtgcctgtaatcccagttactcaggaggccgaagtgggagaatcgtttgaacccgggaggcagaggttgcggtgagccgagatcgcgccactgcactccagcctgggtgactgaatgagactccatctcagaaaaagaagagattgaagagtccattaaagatgagggagtggagacagcaggtgtagatgacccagagttgcccgtctactctagaatgatgcgcatctatgagttctctcccttgtcattcttgaggtcagggaccgtgccgtggtgatttctgagtcataaatggagtccagccagtgcgtagcaggagctcagcacgtttatgtcatggatgaataaatgggtgaatggataatgcattgtttgggtcaaaatggcctttactagtagagatagcttaatgtttttgaagcatttgaggaaacaaaagaaagtcaaccccaaaggccataggttctgtgtcccttctcccagctaacctcaaggagcagttgcctgtgggcctggggcacgagccctggcccagcgtcgggaaccaggttatttatttattgagacagagtctcgagtgtcacccaggctggagtgcagtggtgcgatcttggctcactgcaacctccacctaccgggctcaagtgattctcctgcctcagattcctgagtagctgggactataggcacgtaccaccatgcctagttaatctttttttttttctttttctttttgagatgaaatttcaccctgtcacccaggctggagtgcagtggcgcaatttaggctcaccgcaacctctgcctcttgtgttcaagcagttctcctgtctcagcctcccgagtagctggggctacaggcgcatgctaccgcacccggcttatttttgtatttttagtagagacgtggtttcaccatattggtcaggctggtcttgaactcctgacctcaggtgatccacttgcctcggcctcccaaagtgctgggattataggtgtgagccaccgcgcccagcctttttttggatttttagtagagaggagatttcatcatgttgggcaggctggtctcgaactcctggcctcaagtgatccacccatcttggcctcccaaagtgctgggatcataggtgtgagcaccgcgcctggcccaaaaaccacattactgagtcccttctgctgcctctcacatgccttgtggctttggataaatcccttcctttttcttagaagtgatctgcatggcggctcacacctgtcatcccagcattttgggaggccagggtgggagaatcacttatgcccaggagtttgagaccagcctgggcaacatagcaagactccatctctgcaaagaaaaaaagaagtaggctgggcgcagtcgcacacgcctgtaatcccagcactttaggaggccgcggagggcagatcacttgaggtcaggagtttgagaccagactggccaacatgatgaaattccgtctctactttaaaaaactacaaaaattagccaggcatggtggcatatgcttttgatcctggctactcgggaggctgaggcaggagaatcgcttgaaccaaggaggcagaggttgcagtgagccaagatcgtgccactgcactccagcctgggcaacagacagagactccatctaaaaaacaaaacaaaacaaaacaaaaaataggcaggtgtggtggtgcacgcctgtggtcccagctacttgggaggctgaggtgagaggatcgcttgagcccaggaggtcgaggctgcactccagcctgggtgacagatagagcaatatcctgtctcaaaaaaagggaagccatcagcgcagcacaggggaagcagcccacgtgagccagtcccatagatattcgtttccctccttccccacccccgccccgctgccccctttttttctctctctgggctttttacttgtttaggaactcgaagcggttcatggcaagtaccccgagtcctagcccacctgctctctgcatagggttgcggcagagcacctcacacgcgcagatacacgcctggctttaggggaagtcgcggcactgggtctgcagagtccgctgagcacgcaccttcgttgtgaaactaaggaaaccctggagtgtccttgggcttgggtgggatggaacatgcccgtgacagacaggcccacctgccaatcagaagggcgctctccttagctgggatggggccgcaggagtggaaatggctgttgggaggtggcagagatgggagatggggtggccacgggggagccgccggccacagaagaggaaacggaggtgcagggagcggagtctgcgaaggacgcgtggatggccaagagatgtgcctcggaaagggccgagggacttcctctgaccaacccccgacggccattcccagccatccgttttcctgcagccgcggatgcaacctgtggaagaggcgggaggaggcccgggagtccgccccgctgcgcctttcctagggtgggagcgtggactcaggcgcggccgctgctgccacctagtgggagacgcctgctactcctctcggttcctaaccccagggtcgttcccggctgagcactaaggagggggcgggggaggacggagagagccctgtgcccctggatctgcggataggatgcaagggggagcctcagagaggaaccccccccccaggaagtgtgcattgcccacactacttttcccctctgtgccgtgatttcctcccgtgtataagggaggcaagagtacctgcctctgggctgggcttggtggctcacgcctgtaatcccaacactttgggaggccgaggcaggcggatcatccgagttcaggagttcaagaccagcctggccaacatggtgaaaccccatctctactaaaagtacaaaaatcagccgaacagtgatggtgcgcgcctgtaatcccactccaggaggctgaggcaggagaatcgcttgaacccaggaggtggaggttgcagtgagctgagattgtgcgtctgcactccagcctggcggacagagtgaaactccatctcaaaaaaaaaaaaaaaaaaaaaaaaaaaaaagagtacctgcctctgagggtcagtgcaagagcaaatgaacaaatttgtgcaaggtacttggccataaatggggtccagccagcatagtaataggtgttcaataaatgctacctgctgggcatggtggctcatgcctgtaatcccagcactttgggaggccgaagctggaggatcacctgaggccagaagttcgaaaccagcctgggcaacatagcaagccctcatttctacaaaaaatgcaaaaattagccgggcatggtggcacatgcctgtggtcccagctactcaggaggctgatgtgggaggatcacttgaggccaggagttcaaggctgcagtaatcataccactgtactccagcctgggtgacagagtgagaccctgtctctgaaaatacataaaataggccgggcgctttgggaggccgaggcgaacagatcacctgaggtgaggagttcaagaccagcctgaccaacatagtgaaaccctgtctctactaaaaatacaaaaattagccgggtgtggtggcagacagataaaaggaagggatttatccaaagctgtaatcccagatactcaggaggctgaggcaagagaatcacttgaacccaggaggcagaggctgtagagagccaagatggcgccactgcattcccacctgggtgacagacagagaccctgtctccaaaaaaatgaaaataaataaaacaaatgttacctgtggttgatccaaggggtaaccggaggtgtgtggccctgtgccaccaccccaaattgtgcctgttgtccaaacacagcttcctttagttcgggctttcagcaagatggccgtgccgcatccctcctctttgtaaatgctggggctgccaccattatggttttatcatcagcgacattccagggggtgaagactggtcccaacctctcttctcctctcctcttctgatgagagtgagggatgggggaggggtcccagctcctagcactttctcccctcaccccaaagtgccatcagaacagctctgggctgtgacatcacagagcccccacctcatgataggagtcatgaggctgtggccatgggtgctggtgtgggtgtggctggctgcactaggggccatagaaactggtaagaagctgtcttgggagcagcaggaaggcaggcagctctgggagcataaagtgtgatgcccacttagggactcggaagccaaccctgcaccctctcattttctctccactcttctctcccatcctgctggtcccacctaccccccaacaaccgcgagccttgtcgtggtgcacccagctgaccctgagggaaatcaagaccctccacagcctctgcaataaggctgggtggtctcacagggtcccaagtcagcttccgcctcgagagataaaggcaggggtcagcttggctgttgtcacagagtttgcttgggtcctagcacccagacccaagcgtgccacggcgtcagccctggggacagagtctccgcgcttcttagacagacctgacttcttcgattatccggactcagaccaagccaggctgctggctgtggcccagtttattggagagaaacccatcgtgttcattaactcaggtatgaaccagcttgagaagggacctccctccccgccagggtctggaggagagcagccccagacccttcattgggccatcagaggggagttaagggtcctgtttgtctagcaggttccagccccgggctcttccatcacatcctggtgggcttgctggtggtggcgttcttctttctccttttccagttctgcacccacatgtaaggcctgccccctttctccaaccccacccaccaccaccttccttgggagcggctgaagaccccagttctagcggggcaggctgtgacctctcccctctgatctccatgccccacagaaacttccagaaaggggcctaaagagccggacaagggctctggactcaacctgagcacccacacccacctcctctcctgttgatgagcaaaagttccctgctttcctcctccctgactgcccagcgagcagctggggatcctgtcccctctgtttcccatggcccaagccccccacctcctcccttcccagccccaaagaacttggtggcaagggccttggtggcgttcacgcagatcgtcttttattagcggtctgtaaagcacctcccagggtcccccgaccccagattggaggaagccttgagaggtcagtagcaccagggacatggcagggcccgagggcgcgatgtgcagccgatggtgagggactgggcgccctcgcctgcccccggggttgtcagcactgggaaggcttgggggtagcagccacctccttcccccaacccaacagactagttcaaatttgggtaaataaataaaataaataagattcctcaagctggcctaccctggagaggagccgtggttgcagccggccactcgggaggcccgagggccagcgggggttagttggggcgtcctctcctctcgggtgatggggagccctgggggatggcagcataggggctgggatggccttggcagaggcgtctccccacattctgactcctggtccccttgaaaccctgttggtgtccctccccacaagccctcctgccctcagtgggtgggaggcggtgccccctcccctcctccagcgcaagggtgtgcaggaagggggcagagtagggggaagaggtcccctctctccaccccctcagtccccgagagatggggcctcttccctttcggggtcatcgtcagtcctggggttgtccgggcaagaggaccctggctcccaaccccagccatcagccccagagccctgtctccacgggggtgggggtggggagggggagggtcccggcccccggcctcagtcctgggcctggcaggccgggggcggccgggagcggggccagaagaggcggcaggccccacggcagatgaggaagaaccagtagagctgaggggccaggagcagcgcagcgcccaggttgacgtgggcagggatggccaggggcacggccagcaggggcaggccggcatggcgcccgtaggcccagtacaggtagggaaagagcagcacccggcagcagaggaagctgagcagcatcagggccccgttcaccttgtgcagcagtgtgtgctgctgcttgtactgaggagacacagacacagtggccacggcagcagaagggctcggccccccttggccctctccctgcctccctgcgaccctagcaggcagctcctcccaaaccagacactttgccaggacacaagcaccaggtgctcaaaatgcacggggtgagggggggatgacgaaggggctagagcccttggcagcaaccttgaaggtccctccccttcctgtgacctccccattgggctcctgcaccctcccatgctcactcacctggatgaggatcttgccaaggcagacgaagggcgtgctgacctctgccatcaacatgcaacccagaaagaagtctcccttaccctgtcgccacacctgggcacagaggcaggaaggtgaggagctggggctctccctgggttcttgggcagcccccgcccttcctctttcccctctgtcactttgggagatgcttgactctgaacatcagaacacctgggtgcagggctgggtgcagtggctcacgccggtaatcccagcactttgggaggctgaggcaggtggatcacgaggtcaggagtttgagaccagcctggccaacatggtgaaaccccgtctgtactaaaaataccaaaaaaattagccaggcgtgttggtgggcacctgtaatcccagctactggggaggctgagatgggagaatcacttgaactcaggaggcggaggtttcagtgagccgagatcacaccactgcactccagcctgagtgacagagagagactccgtcttggaaagaaaaaaaagagaaagaacacctgggtgcaggagcaggtgcatgacttggctgcatccctctcacggtcctgcagaaagactgtgtcccttatgtaacaggtgaggaaactgaggctcagagacgtgcaaccacaaatccaaagagccacagccgggcatcgtccagcccagggccaggctgcccccacaccctggtgccctgggctggtgctcagtgaaccctgcctgtccacagctttccctgggaatacgctgggtctgcttggttgtcagtacgcagacccggggcttcccaggctcctgccagcaccagcaggaccaaggagcaggccacccgcaccccgcccgcccagctccccgggactcaccactgagagtgggaagcacaccagcaccatggcggcatggtggagcaccatgaggaactccttgtgcaggtagccacgcgctatggcccacgtgctgcccggggctctggccgctccgtcgtcccctccatgccctttgacctggtgcttgtgccagtgacagaggaacatggcgtagatgtcgtagatgaagtagggcacagcaaattgcgtgtaggcagaggacagccagtgtctgttgggcagagagacggggtgggggagcaaggaggaaaggggacaccagtgattggggtcagatctcaggggtcagcacagcagccctggacaggagcggagtcttgggtacagatgagggatccagagggtagagggtgagaaacttgcccaaggtcacacagtcatgcagctagtaagagatggtgctgggattcaaacctgtggtctcagaactcacccatgttcctctctctctgcagtatagtcgggggaaaagaaaagaccagaagatgcccacagaccaaaaggcacagatacagtgccaaaataagcccaggacaggcaggtgggaccttgccatggttatttgtcctaaccttaccatgaggttaggaccagcaacagctgaaggggcgagagtgctggagagagaggtcacaggggtggacgcccattcctgcctcctgggacaggcgatcttccaaacttcccatgcatagccttatttacccctcccaaaaccctgtaaaaggtaggtgtggccatcatccccactgtacaggtgaagaagtgagtcacagaggggctaggtaacctggccaaggaagggacatgggcggtgtggctccacagccctcactgtcatccccaccatccccagaagatccgagaggcatcagagacagaccctgttggcaagtgagaggtcttgtcagcgctgttcgccctgccccaaagtcacccaatctcttgtctattttgtgttgtttttcagggacagccaagcgttaaggggaaaatgcagagcaaaaggagccaaggacaaagaaagttccatgtacttggagagtaaacaaaaacgagaaatggatgaatagacaagacagcatttttcttctggagtcagcacattggcagtttctcttaaatcctgtagtcccaagactggcctggggtgggggcaggaggtcagagaggcaggacctggggtgctcgccccacaaggggtggagggatgaaagcagagtcagccagaagccatcaccaaacatgaggcacgtggaggaggctgtggagaagttggggctgaggcctctgaggatggggagcctgaggcaggcggcctgtgagtggagccaacccattctccagcagggacggtaccagggaaaagggaacctgagactggtgcagtggtgtggagctgcggcccagaggcagggaaagatgagaggggaggggcagctgtagagaacgcgaagcgggaacacagggagagaggtcccaagtggcctggaggagtcagggcaggaagctgcccagaatgcaggcccagcagaggtgatgggagatgggacagctgggctggtgcaggagaccaggaggggccaccaggccctgggctgtcatgtgaggtgttagatcccatccccaccctcttggcaattaggtgctcagaagtaggaacagctgctgccctggattaacccggatcctccccacctacctgaggattaaagcagggaagacggacaggaacagacacaggggggcctggggagcagggggtacagaagctaaacggtgacctctgcatgtgaaggctggggaggaagtgctggatcccaggctcagcttggagcaggggagggaaggggtgggcagaggccaagaagcagccaagtccctgggcggggtctgaagaaagagttaagccaagaactgtcctctgcagctgccacttaactcaattcctctcgctgaagcccttccaggaagggccgctgcctcaccacagaagaggcaactcatcttcgggaaaagaggaggcaaacagaaacagggcaccccccatcaggggcgtccaaatgttccctgggactcagtggctgccacagaagggaagcggtgctgaaagctacaaagggggcgttgtgggcacctctaaggcaacttgcaacgggccacccgtgggtcacctagggcggccgtcagcaccacggacagggcccctctcctccccgtccccccgcctcctgcctgcacacctctgggcctttttggcaaccaccagacactgcagcagctgcctggccacattttggcctcttcaccctcatcccctcccgcactgcctggccgtgtgtggccttgtgcgtgtcatctctcccttgtcctctccctcaggcatggagtggatgccggatgcctggattatgggaagggctgaggggtgagcctggcatgaggagggggcaccccatctgggtgctggctggaaatggggtctgcctcctggggtggaaggcagggaggaggtggggaaccacgacaacacgggagacctggaagccgactagaaagcgctttgaggatcctctctgatccccgctccttctccccctggttctgacctttaaggacaggacaggataaatttatccctgggtgttgagttgcggttattgcagttaacttgctcaggcccaagttaagggcttggggaccacagacagagttccctccaagatgtggggtcttccgggattacccgtacacgccaaccactggcacctgggcaggggggtgtctcgcagcacttactggtcatcaatgatgtgcttgcaggaggtggagacgatgtagccggcagtggaggccatgatggcctggacagaggacaccagcctgggggagagagggaggcgtgctagaaaggcagaagggaagaggcgtgtgccttgatttctcctcgttgctagtctaacgactgcgctttgcgttcagccacttctcgggccagtccttgcctgccttcgcccaaggctgggctgcctgaggtgtgccccaccacaggtacctcacggctctccggcccgctcggctgctgttcctcagtccaccccactccttgccaccttcttccttccccatttgtggaaactgagtctccctcttctcaagcccgcagggtgtctgtcctgaggtgagactgagagtgaactgctggcctggacctctccccacgaggggagcctgggccggttcttgccccgcttagctgtccagtcatgacgcaggcctcactctggaccctttgtgaccccgagttccccagtcactttcccactgtctcctgactgccaccagcctccactctgcactctggccctgttctaggggtgtagagttgtaccatccactcctccatccctggcccccaaacactcaccctgaatgacacctagctgtctggccctggcctcagtccctaatgtcttataggaatgtcttcgccgcatgctggccctgttttggagggtgggagggtgtacggggaagaagagagaggcgggctgaacactagtagaccagatggccgggctggatgaggtctcccagaacagtgagcaaggcaggcagtgaggagagaggaagcctgggggtaaagccccggacccccacaggagctcccagtcccccaccgctgagggtccagagaagtgccaggtcccttccattccctgagaagcccaagaagcagacaggggctgaggggaaagaaagtggtttacctggctgagacaatgactgcgtcggcctcctcccagcgtagctggggcagccgctggagcgtgttcttggagaggaggaagagtccggggaacaccacccccccggccaccatcggggtcagcatggtggctcaggacttgggcagggaggcaggcgggccgtgaaggggcagggaggccgagtggaaggagttaggggtggagaagggacgccaagcccgggaaggagggagaaaacgatgagaaggggcacaaaggggccagggcggggacgggatggggccagggagtccgatgaaactggggagtcgggagggggctggctgggcagagacgggggaggggaggatgggagaaggggagcaggagcaggccagcgagggatggggagaggcaaagaggggatggcttggtgagggacagagaggaagaggggacaggaggaggaggatgcggatgggggaggggagggagccaccaggcaggtggggaggggaggcttacgtgagaggctgggagggcccgaggaggcggggagggggtgggggtgggtctgagtaccagccccaaaggaaggaggtgggcgggagggagcggaggagcagccgggcaagcggtcagcggtcaccaccgctctcctggctccactgcctcctctcgctgccgccccagtccctgccgcccggcacagacaccgcacatggcatcatcatagagactccgtgcccagccccctgccccctcggtggggagggggagggggaggggaagtggccagcttggggaggacgggggaggggcaggaaaatgatggcaccgaccagacaccgagaaaccggacctgcagcggcgtctccccatgcagctctgagccacagccgcggctgcgacagagatggggggagcagagaaagagggagggggaggcccttaaaggaacagcagctgcggtggcacagggggctgctggggacaggggacaggggccagctcttctcttggggaggaagggggcccagggctccttggccagctgggagggggccctgagcccccacaggggcctgaccctgcttcccatcagcactttgcaaatgcctggcatctcctccctcaccaagccatccctctgtggcctgccccgggtccgagctttgggtggccattccagcggaagagagcgttccctgggagagggagtaagtggtgctttctcagaaggaagagctgaaggaggggataggagcaaaaacatctcaacacagcatcctcagagccagaggccccctcacccgatggcggggaaggaagctgacattggccagagggggcacctgactgtgctgcagggctgcccatgtcctgtctgctgcaggagctccgaggtcactgcgtctgtccttcccacagggccatcaacgatcctgaggctccctgaggtcacccagttcagaagtggcacagccctctcattgcaggcgttggaggggcaaggagtggaagaaggggaaacggtggcgagagcgcggggcagctgcctctcaggaagtcccagggagccctaggatgcccaggccctgttcttcagactgccagcccctcctggccttctctaaattcccacccctcactttttcctcagtttccttaatgctactagctcccctttctctgcaacttccacatacagcctagtttcagagtgggaaaggactgcggggtgggctggtgcaagctcctcactggcccataaggaaagtgaggcctggggactgggcccgggtggagctgtgggacctgagccagagacactgccccctttgacttctggcctcccatcctgctcccaactgtcctgtggacttcagcatgacaagggcctgttatgcaaactcctttggtctccaagttcaatagtcaaccctatggtttgcctttctctgccagagcccactcctcgcctcccccaaagaaaggccagggactgggatttgctgttttgtgctgccctctagcggcaatctgtaggaaagcacccaagaagtctcacgctgatttagagacggttgtagagacaatagcggacctagctcctgtcctcagcccttcacgggagggggaaaggggatccagctccctgagtttttactacatgctgggcacagtaccaggtgatttctactggttcttacttggtatccctgttttacagaagaaacaggtttagaaattttgtggggttttttttttttttttttttttgagatagggtctcattctgtcccccaggctggagtacagtggcgcgatcatggctcactgcaacctcaacctccccgggctgaaatgatccttatacctcagtatccccagtagctgggactacaggcgcacaccaccatgctcagctaatttttgtattttttgtagagatgaagtttcaccacgttagccaggctggtctcaaactcctgggctcaagcgatccacccacctctgcctcccaacatgctgatattacaggtgggagccaccacgcccggatgaaagctgggtttcaaacccatggttgcagccgggcaaggtgtctcacacctgtaatcccagcgctttgggaggccaaggctggcgaatcatgagatcgagaccatcctggctaacacagcgaaaccccgtctcttctaaaaatacaaaaaattagccgggcatggtggcatgcgcctgtagtcccagctacttgagaggctgaggcaggagaattgcttgaacctgggaggcggaggttgcagtgagccgagatcgtgccatcgcactccagcctgggcgacagagcgagactccatcttaaaagaaaacagaaaaaccaaaaaaccatagttgcataaccccaaagccactcatgagcaaaactgcaaaaaggacagaggctggggaggctgggtgatgggcggccaccgtaactactcgattgaggactacaaggctggtcatggaactgtggtttcactttggatgagtagagacaggctttttttgtctgccagggaatccacgtagacaccctagtaaaatctgtgttccgtgtacctcctacgcctcctgtggtttgctgatactgcacttttatggtaagctttgtcacacaggtcatagatctgcagcccaagggcccaatccggcccacagacatgttttgtttggccagtatgcagttgtcagtatagtagttcttaaataaattcttagttacttatcagtattcaagaattggaagaggttgggcgtggtggctcatgcctgtaatcctagcactttaggaggccaaagtgggcagatcacctgagatcaggagtttgagaccagcctggccaacatggtgaaaccccgtccccgtctctactaaaaatacaaaaattagccggacgtggtggtgcacacctgtaataccagctactcgggaggttgaggcagaaatgttgcttgaacttgggaggtgaaggttgcagtgagccaagattgagccactgaactccagcctgggcaacagagtgagattctatctcaaaaaaataaaaagaattgggagacagcccaccacaatgacatgcacctgtagtctcagctactcaggaagccaaggcaggaggatcacttgagcccaggagttcaagaccagcctgggcaacatggagaaaccccgcctctactgaaagtacaaaaattagccaggcatggtggtgcacacctgtagtccaagaaactcaggagtcagcccgattctcagggagaatcacttgtcagggaggtcaaggctgcagtgaatcatggtggtgtcactgcacttcagcctgggtgacacagtgagactctgtctcaaaaaaaaagaagaggccgggtacagtggctcatgcctgtaatcccagcacttcggaggctgagaaggaacaatcctgtgagcccaggagttcaagactagcttgggcaacatagtgagaccctgtctctaccaaaaaaaaaaaaaaaaaaaattagccaggcttggtggtgcattgcctgtagtcccagctatggcaggaggattgcttgagcccaggagttcaaggctgcagtgagccatgatcgtgccactgcactccagcctaggcaacagagcaagaccctgtctcaacctgtctcaacaacgacaaagaatcataactccgaaaatattggcccacgttctaaccatataacattatcagtggctggagctgagcagcactggccctcagcagagaaggtgagtcctccagcctatatcatccctgcagagcccacagccctcatattatctgcagcagttttcaacccctgctctacagacgctgattcatatgatcctcacacaacatctccacgaagaaaggaaagtggggtgttattattaagcccatttaccagtgagggatctgaagttcagagaagttaaatgactcacaaaagaccccactgttggtgtctttttttctttttcttttttttttttttgagacagagtctcactctgtcacctaggctggagtgcagtggcgccatctcagctcaccacaacctccacctcccgagttcatgtgattcccctgtctcagcctccagagtagctgggattacaggcacctgccaccatacctggctaatttttgtatttttagttcagacagggtttcaccatgttggccaggctggtcttgaactactgacctcaggtgatccacctgcctcagcttcccaaagtgctggaattataggcgtgagccaccacgcccagcctgctggtgtcttttgactccacattccagctccactccacactctgcttctgctttcaccacaaactcattctgaaagtaaaagatcagttccaccagccatggccccaggaaggacaccctcaccctggtcctcttacttggatgctaccaggacagcctcttgtctctccatctgcaggttggtgtggttctgcaagccccagcgcagggcagtgaagcacaacgggaagaagacgcaacccactgcgaacagcagggtcatgcctgcctgcagccaagaaggcagaaaaagacggccatgagaacacctcaacacaacaccctcagaccccccagcagccttcttcacccccaatgaggcaagccccaagagacccatccatctgtggccattgaaagccaccaggcaaacctcttctctaagctcctagcatccttattactcttttaatattcctcatccggggcaattcgacatcctaattatcccaattttttgttttaaacactcaatttagacaatttcttttcttttcttttcttttcttttttctttttttttttttgagatgcagtcttactcttgttgcccaggctggagtgtggtggcgtgatcttggctcactgcaacctccacctcccgggttcaagcaattctcctgcttcagcctcctgagtagctgggattacaggcgcccgccaccatgcccagctaatatttgtattttcagtagagacaggactttactgtgttggccaggatggtctcgaattcctgacctcaagtgatctgcccgcttcggcctcccaaagtgctgggattacaggcatgagccactgcacccagctcctcctactcttaaactccaccattttccatcttctgcatgccccgcccgccgcccaccctaagtcacctctaccttctccccagtcctcacctcagagggacaggttggaagacagaaagggaggttgatgtttctcctcagcacccagaacttggaaaaaggaagggagggggttgtcaagatatttggaactttaaaatgacatttgttgaaaaaacaaaataaagccaaagcgattgttgttccattaaaaaagaaaacaaaagaaataacaggtgcaagcctgaaactacatatatttacatagatatcatttttgtttagaaagacctcccctcccatctactctggggagcagaggtgtggagcaggcacaggcaggatgaagggaaccaggtcctgccatcctgccttcctgaagtgtcttccaagggaccttctcgggataaaaggaaggtgtcaaactgcaaaggcacgaggctgctctgtagaggcagttggggagggcaggagtatgctcttccattggtggagtggctagaaggtgccatcctcctaatggcccgccagttgatacatgtgccctatcatttgcttcctgtgggggctggggggcggttccagcaagccttgcctagaattggccaattagaatccattggtgacttgatggacagctatgtttcagggacagggctcaaagaaagaaaaggagaggggaaataagagcaggtgcagggccgggcgtggtgactcacgcctgtaatcccagcactttgggaggctgaggcgagtgggtcacctgcggtcaggagttcgagaccatactggctaacatggggaaaccctgtctctactaaaaatacaaaaattagccaggcgtgatggtgggaacctgtaatcccagctattcaggaggctgaggcaggagaatcgcttgaacccgggaggcagaggttgcaatgagccgagatctcgccactgcactccagcctgggcgacagagactctgtctcaaaaaataaataaataaataaataaataataaaataaaaaaaaaacagcaagtgcagtggttcaggctggaatccccgcacctcagagaccgaggtgggaggatcacttgaggccaggagttcaagaccagtttgggcaacatagtggaacccctgtctctacaaaaaattagaataataggccgggcacggtggctcccgcctgtaatcccagcactttgggaggccgaggcgggcagatcacggggtcaggagatcgagaccatcctggctaacacggtgaaaccctgtctctattaaaaatacaaaaaatttagccaggcgcgttggcgggcgcctgtagtcccagctactccggaggctgaggcaggagaatggcgtgaacctgggaggcggagcttgcagtgagccgagatggcaccactgcactccagcctgggcgacagagcgagactgtgtttcaaaaaaaaaaaaaaaaagaagaagaagaagaataaaatagtccagtgcaatgacatatacctgtggtcccaggtacttggaaggatgaggcgaaagaatggaaagaattgcttgatcccaggagttcaaggctgtagtgagctatgatcataccactgcactccatcctgggcaacagagtaagaccctgcccccccaaaaaagtagtcctaagtaattattgatttaaaaggcggtgtaggataaaaggtaaagaaggccatttctactgtgggtgtacatggacttcaaattcagagtccacagataatcaaagaaacatttcacttccctattgctgaaataaagaaacaaataaagaaacacactgtatggctctgtttacatcaaattcagaaaagcaaaacatctatcatgaaaaatctgaacagcgtttaacttggggaaggtattgactgggaggagaccccagggaaccttctgaagtgttggaaatggccttatattgatcaccagtgtatacatatgtaaacattctcgaggcatcctcttaaaatgtgtgccccttaagtgaagctgcagtttttaaaattctaaatttaggctcttcctttctctgaatgatggtgggcaaagcctttatgggcctcaatttcttcatctgtgaggttgggttaataattagtgtcacatcattaaatgctgcttagactacaggtcagacattgatctgcattctctgactctaaaagaaaaaaaaaaggccaagtgtggtggtgcacacctgtagtaccagcactttgggaggccaaggcaagaggatcacttgaggacaggaggttgaggctgcagtgagctttgatcacgagactgcactccagccttgggccacagagtgcgactccgtctctaaaaaaatcaattaagggctgggcgcagtggctcacgcctgtaatcccagcactttgggaggccaaggcgggcagatcacaaggtcaggagttcaagaccagcctgaccaacatggtgaaaccccatctctactaaaaatacaaaaattagctgggcatggtggcatgtgcctgtaatcccagctacttgggaggctgaggcaggagaatcgcttgaacctgggaggcggaggttgcagtgagctgagaagccgagatcacgccactgcacttcagcctgggcgacagagcgagactctgtctcaaaaaaaaaaaaatttaattaaaaatatcaagtcatttatccaaagcaaccttgtgggtagggattattactgcacctctgttttacagatcagaaaacagaggcacagagaggtttggtaacttgtccaaggttaaacagtcaggaagtgaataaaaattttttaaaatcatattttctgaatttatttgtccctataatgttaggcagatatagaaaacataaacttattttcctaaggaactgaaaggcttttttaaaaaggagggaaaaaacaccactgaatacaatttagacatcctcattcatattttcagaacttatccttctcctcctccttcctctcttttttttttttttttttttttttttttttagatggaggttcgctcttgttatccaggtatccaggctggagcgcaatagcgcaatctcagcttaccgcaaacgtcgcctcccagattcaagcgattctcctgccttagcctcccgagtagctgggattacagccatgcgccaccacgcctggctaattttgtatttttagtagatatggggtttctccctgttggtcaggctggtctcgaactcctgatctcaggtggtctgctcacctcagcctcccaaagtgctgggattacaggtgtgagccactgcgcccggcttcttcctcatattcttttgagacagggtctcactctgttgtccagactggaatgcaatggcatgatcctacctcattgcagactcaaacttctggactcaagcaatcctccttagcctctgcctcagcctccagagtagctgggactacaggtgtgcacacaacactcagctaatttttgtatttaaaaaaaaatttttagctatgttctatggaaaggaatctttgtactttttatagagatggggtcttgctatgttgctcaggctggtcttgaactcctggcctcaagcaatccccttgccttggcctcctaaagtgctgggattacaggcatgagccaccatgctcggccagtgtttgcttctttagctactttattttcttccctctggatgggactctgaaaattaaaagttaaaccaagagcggccaggcatggtggctcacgcctgtgatcccagcactttgggaggcagaagggggtggatcacctgaggtcaggagttcgagaccagcctggccaacatggcgaaaccccatccctactgaaaatacaaaaattagccaggtatggtggtgcacatccgtaatctcaatcactcaggaggctgaggcaggagaattgcttgaacccaggaggcggaggttgcagtgatccgagatggtgccactgcactccaatctgggcaacacagcaagactttgtctcaaaaaaaaaaaaaaatatatatatatatatatatatatgaaaagatcctgagctggggtctgaaaccaggcagcctgccctgctatttgcccagctcctgcatagctcattgtgaggactaaatcatgccaatgcatagaaactacaatacttcacacggtagccagtagccagttactgtcattctgagcacccactgtatgccaggcaccaggctgaaatactttatatacatgttcccgtttaatcatctatgccaccttacaaataacttcctcattttactgctgagaaatctgagtctcagaaaagttgaatgacatgcttcagaccatacagtacatgacaaaatcggtaaatgtgaccgctgccttccaagtctggagaaaaggaggcgaagagaggggaaggcatgaggggaggagagaaggtgggagagggaaaaaggggaagagaagggatgagagtaggagaggcagaaggagtgaggaggagtagcacccctctgcagttattttctttttctttttttttaaatttgagacagagtctcactctgtcacccaggctggagtgcagtgacacaatcacagctcactgcagcctccacctcccgggctcaagtgatccttccacctcagcctcctgagtagctgggatgacaggcgtgcaccaccacacctggctaatctggggaggtttttttttctagagatgggatcttgctatgttgcccaggctggtcttcaactcctgggctcaagcgatcctcctgcttcagcctcccagaattctgggattacaggcgtgagccactgagtgtgaccagggatggtcattttcctctgcacctgtgcttaccctagacaagaaaatgtggaagggaggaaagtttacaggccatgagctggttagagtcaggcccgagtctcactggaatctggactctctcctacatttcttcctttccttgtcgatttcttcttgttgagagcaaaacagtccaaggctgcacaggcttgtctgagagagaaaatatgagaggagaaaattgtggttttgagcaatggctttaaatttttttaatagtgacccacaagagatatcttttattttatttctttatgtatttattttttgtttgtttgttttgtttttttgagacagagtcccactctgttgtccaggctggagtgcagtggcacaatctcagctcactacaacctccacctcctgcgtaaatgattctcctacctcagcctcccaagtagctgggattacaggtgcatgctaccacgcctggctaatttttgtattcttagtagagacaccatattggccaggctggtctgaactcctgacctcaagtgagctgcccgccttggcctaccaaagtgttgggattacacacgcctgtaatttttgtaaaatacaaaaaattagctgggcatggtggtgggtgcctgtagtcccagctacttgggaggctgaggcaggagaatggcatgaacctgggagacagagcttgcagtgagccgagatcacgccactgcactccagcttgggccacagagtgggactctgtctcaaaaaaaaaaaaaaaaaagtgttgggattacagaggtgagccatggcgcccagccgagatatcttttattttgtgactgcagttcatgcacccacacgttgaatggaaaacctttgcacaacacattctgacttactatatgcagtgccctgtggaattttctagaccatttttccaccaaatattgatcatgacccattaagccaatttcactgcccactagtggctaaacaagccaagcgggaaaaatcttggtttggagagcagtgtttctcaatttttctttcattattgttcccctaaggagccctttttacacttttttttctaatcgctgcctatcacgaaagtttaataacacagatatatttatgtctatttacatatatcttttccatattaaaaagagtaagttttttgcccccttgggggcgatattataccagttgagaaggcatcattgtcctaatgctcattttctgagccgcctttatttatttatttacttatttattttattttattttatttttttcagatggagttttactcttttgcacaggctggagtgcagtggcacgatcttgtctcactgcaatctgcccccgctgggttcaagcgattctcctgcctcagtctcccaaggcgcccaccaccacacccagctaatttttgtatttttagtagagacggggtttcaccatgttggccaggctggtctcaaactcctgacctcaagtgatccacccgctttggcctcccaaagtgttgggattacaggcatgagccaccgtgccctgcctctgatccgcctttatacacatcaatcccaacatccaatgagataggattagttccattttgcaagtgattaagtggaagctgagaggttatattaattattgaagattgaaatggctggcaattagactgggaatccagaaacttaccaatatcctaactcagcctctagcttctccaaacctttgtttccccacaaaaaaaaacctcagttatggtcagttatgggtgttttttgttgttgttattgttgttgttgtttttctctatttgacctaataagagcaaacattaggccaggcacagtggctcacacctgtaatcgcaatgctttgggaggccgaggtgggtggatcatgaggtcaggagtttgagaccagcctgaccaacatggtgaaagcccatttctactaaaaatacaaaaaaaattagccaggcgtggtggcacacgcctgtaatcccagctactcaggaagctgaggcaggagaattgcttgaaactgaaaggcagaggctgcagtgagccgagatcagaccactgcactccagcctggtgacagagtaaaactccgtctccaaaagaaaaaaaaagcaaacatttatagagcatttactagacatccggcagcaatctaagccctttatatatattaactaacataatatccacaataatcttaagacagacatactggggtttttgttttgttttgatttttgagacggggtctctcattttgtctcccttgatgaagtacactggtacgattagctcactgtaacctcaaattcctgtgctcaggggatcctcctgcctcagcctcccaagtggctgggactacaggctctcaggctcatcactaccagcttattttttaagtttttcctacagatgggggtctcgatttgttgcccaggttggtctcaaactcctggcctcaagcattctcctaccttggcctcccgaagtgctgggattataggcacaaatcacgtgtcaggtgagacatactctcagtcactgttcggatgaggaaattgaggcacagagaggttgtgtggcttgctcaaggtcatgcaggtagaaagtggcacaagcggggatttgaaccaagtaatctgattttcagagcacaggttgtgcgttttgttttgtttttcaccatgtattattttttgagatggggttctcactctgttgcccaggctggaatgcagtggtgccatctcagcttcctgcaacctccatttgccaggctcaagtgatcctcctgcctcagcctcctgagtagctgggaccataggcaagccaccaccatgcacggctaattttttgtatttttggtagagacagggtttcgccatgttgctcatgctggtctcaaactcctgagctccagcaatacgcccgatcctcctgcctcggcctcacaaagtgctgggattataggtgtgaaccaccatggttagcatgagctaaccatgtccttttttttttttttttaactctgtctcccaagctaaagtgcagtggtgcgatctcagctcactgcaacctccgcctcccaggttcaagcgattctcctgcctcagcctctggagtagctgggattacaagtgtgtgccatcacacttggctaatttttgtatttttagtagagatggggtttcaccatgttgcccaggctggtctcaaactcccgacttcaagtgatctgcctgcctcacacctcccagagtgctgggattacaggcatgagccacagtgctaaactaaccatgtactttattttctttcatttgagatgaagtttcgctcttgttgcccaggctggagggcaatggtgcgatctcggctcactgcaacctccgcctcctgggtttaagctattctcctgcctcagcctcccgagtagctgggattacaggtgcctgccaccacactcggctaattgtttgtattttttttagtagagacagggtttcaacctgttgcccaggctggtctcaaactcctgacctcaggcgatctgcctgccttggcctcccaatgtgctgggattacagaagtaagccactgtggctaccatgtactttaaaaggaaactttttatcactctggaaaatagaaaaccagtaccacctgtgataaacagaaggtaacaaaaaatatacaaaatgaaaacacattttataacattctagctagatactatgggcagctgctcattctgaactggaggctggctctctccttgttcaaaaaagaaagatcaggccgggcgcagtggctcaagcctgtaatcccagcactttggaggccggcgggcggcgggggggtgcggattaactaaggtcaagggttcgagaccagcccctggccaatatggtgtaaccccatctctactaaaaatataaaaattagccgggcgtggtggcatgcacctgtaatcccagctagtcaggaggttgaggcagaagaattgcttgaacccaggaggtggagatttcagtgagccaagatcgtgtcactgtactccagcctgggcgacaaagcaagactccatctcaaaaaaaaaaaaaaaaaaaaaaaaaaagaacaaaaagataagcacagagagaaaggtgttaaagggtttctggcagcaaattgagagtttctcctgcagtaatcagaagcgttgaaagggaattggaaagagaaagagagtagcttgttcagggtgtgtgtgtggtgtgtgtgtgatgtgtgtggtgtgtgtgtggtggggtgtgtgtggggtgggtgtatggggtgtgtgtgtggtgtttgtgtgtgtttgtgtgtgtggtgtgtgtgtgtgtggtttgtgtgtgtggtgtgcgtgggtatggtgtgtgtggtgtgtggtgtgtttgtgtagtgtgtgtggtgtgtgtgtggtgcatgtgtggtgtgtgtgtatttgtgtgtgtggtatgtgtgtttgtgtggtgtgtatggtgtgtgtgtgtggtgtgtgtggtatgtgtggtgtgtgtgtgtggtgtatgtggtgtgtgtgtggtgtatgtggtatgtgtgtggtgagtggtgtgtgtgtttgtgtggtgtgtgtgtgtatttgtgtgtggtatgtgtgtttatgtggtgtgtgtatggtgtgtgtgttgatgtgtttggtgtgtgtttgtgtgtgtgtgtgttgtgtgtgtttgtgtgtgtggtgtgtgtttgtgtgtgtgtgtgtcttcttgctgacataccacctaaaataaacccaagatgggatgcaccacatactctgaacccttgtcgggtggtcaatgggtgttcaggacatcccagcagaggaagggagacacaccagcctgtcctggcctgggtgtgcagccagaaagcatggggccaggctgggcaacacagtgagacctcctctctacaaaaagtcaaaaaaattagctgggcgtggtgctgtgtgcctgtagtcccagctacttaggaggctgaggtgagaggatcgcttgagctagggaggtggaggccacagtgagccatgatcgcgccactgcactccaacctgggtgacagagggagaccctgtctcaaaaacaaaacaaaaacaaacaaaacatagagcattaggcagtccaccacgtgtggaggggcagtgcagggcaggggtataggagggcccatccaagcctctgtgactttggccaccatctttccttcccctagcctgtctccccaggtgagtttcacccccaggcagtccttagagacccgccacccaatttacccttggccttgagtttaccgttctctgttcttccaggttctgccgcccacaggctgtttcactcatcctctccaccgggtgccctgcggaggtgtgcaagtgtgatatcatcaaaggctgtgaataagtaaacaataagtggccagaagtggcctgtttcccacatgatacccagggaagggtccgattccccccgcctgggctctggggcaagtcctggctggcgtgccagagcatttattatttagtatttttacttacctgtcccaggttagggactgtcccaagcaatgccagtcccaccctctatctgcacaccagaaaaagctgagggcacagcaggtgattggagtcagacagctaagggtccaatccctttcttctcacatagactggctgtgtgaccttggccaaatttcacaacctctctgagcctccactgagcacacaccaagtcccattgccaggcctaagtcctgcttctgccagtcactagcctggcatccttgtgcaagggattcaactcctctgagccttgggctcctcatcaatgaaacagcagcacctctacctggggctgctggggtgattaaatgagatctgtgtaaagcacagttgctatacacatacgcattgtgatattcattaatagtcattcaaaatgtatatatttagagatgagatctcgatctgtcgtccaggctggagtgcagtggcatgatcatggctccctgtagccttgaactcctgggctcaactgatcctccctcttcagcctcctaagtagctagaattacaggcatgagccaccatgccctgcctgttgtgtcatctgtctgtctgtctgtctgtctgtctgtctgtctatctatctatctatctatctatctagcgcaatctcggctcattgcaacctctgcccccagcggtcaagcaatcttcccacctcagcctcctgagtagctggggctacaagcatgtgccaccgtgcctggctaatttttgctttttggttttgggtttttttctttttttgagatggagtcttcctctgtcacccaggctggagtccagtggtgcaatctcagctcactgcaacctctgcctcccaggttcaagcaattctcctgcctcagcttcctgagtatctgggattacaggcacgtgccgccatgctcggctaatttttgtatttttagtagagacagggttttaccatgttggccaggctggtcacgaactcctgacctcaagtgatccgcctgcctcggcctcccgcagtgctgggattacaggtgagagccaccacacccagcctaatttttgtattttttgtagagactgggtattcatcatgttggccaggctggtctcaaactcctgacctcaggtgatccacccgcctcagcctcccaaaatgcagggattacaggtgtgagccactgtacgtggcctataattttttttttttttgagatagtgtctcactctgttgcccatgctggagtggagtggtgtaatcatagctcactgtagtctcaaactcctgggctcagccctggcgtggtggctcacgcctgtaatcccagccctttgggaggccaaggcgggtgaattacctgaggtcagaagttcaagaccagcctggtcaacatggtgaaaccctgtctctactaaatatacaaaaattagctgggcgtggtggcgggtgcctgtaatcccagctacttaggagactgaggcagaagaatcgcttgaacccagaaggcagaggttgcagtgagtcaagatcgcacaactgcactccagcctgggcaacaagagtgaaacttcgcctccaaaagaaaaaaaaaaaaccaccaccaacaacaacaaacaaaaaaactcctgggctcaagagattcttccacctcagcttcccaagtagttggaccataaatacacatgaaaattagaaaacatgcatgtctaatttttcttttttttttgtagagatggagttcactatgtttctgaggctggtcttgaactcctgggctcaaccgatcctttcacctcagcttcccaaagtgctgggggattgcaggcatgaaccactgcacctggctatatattttaatgagccttcattctatgccatgtgccttgcatacattttctcaaataatcacagaaagccctgccagtccctgagggttatccccactttccacatgagtacaactgaggctcagtgaggtcaattgacttgtccagggttgcacagatatactgtggcagaactagaattcaaatccagatctttcctggttctaaaggctttttttttttctcgcccaggctggagttcagtgacatgatctcaactcactgcaacctctgccctctgcctccccagttcaagtgattctcctgcctcagcctcccgagtagctgagattacaggcatgcaccaccacgcccagctatttttttttctttttgggggcggagtctctgtctgtcacccaggctggagtgcagtggtgcgatcttggctcactgcaaccttcacctcatgggttccagcaattctcctgtctcagcctcccaagtagcttggattataggcacctgccaccatgcccagctaatttttgtatttttagtagagatggggttttgccatgctagccaagctgatctcaaactcctgacctcaggtggtccgcctgccttggcctcccaaagtgctgggattacaggcgtgagccactgcactggcctaaaggtttttttcgttttgtttccaactgggccattattatttccaacctataagatggaagtaattgtttctgccactcgtgcctcctgtaaggattaagtaagataaagtctgtggagaggcctctgttgacaccagctctagctcagcactgcttctttattcccccagggtaattacctaaacacaagcctttcattttatactaaggaggctggtgaacctcttcttaatctctgggagatgatatcgttggatgtccattggaggcagctgaaagtattagatcagaatcagaactgccaggtcccttcccacgtccaagcctgctgaagcttctttcatcttctgggaactctgcatctctgatctcccacccaccccacgattattggaagtatacaatcctgtctgccctttcctaggggaagtgcggaactacatatgatacatctgacatctccagcttccaacttcgggagaggagactttgcggttagctggctattgtgaagtcagtttttctctgcccccagcaaatgttgtgatgtggatagaagtggggcctcggcacagccaggcgcagtagctcacatctgtaacccagcactttgggaggccgacgtggacaaatcacaaggtcaggagtttaagactagcctggccaacatggtgaaaccctgtctctactaaaaatacaaaaattagccgggcatggtggcatgcgtctgtaatcccagctatttgggaggctgagataggagaatcactcaacttgggaggcagaggttgcagtgcgctgagatcgcaccactgcactctagcgtgggcaacagagcaagactccatctcaaaaaaaaaaaaaaagagaaagaaaagaaatggggccttggcaaagtggggtgcatacatcatcccttgtcttggcttgcctggcaacacacaagcctggggcactgcccgtgctcctgcataatgtatgagcccatggtaggaacaaaacaccagcaccagcgagtctgggcactgcaggccacggacgtgtccaggggccttgccaaggctgaagtctctctgttggcagaatatgcagaatatgtgttcctggaggccttttgtagggctgaggtgagaactggcctcaacttggtcctcaggattccatcagacaataagaccgcccaaggccgggcacagtggttcacgcttgtaatcccagcaattcgagaggctgaggcaggaggatcgcctgagcccaggagttcaaaaacagcctgagcaatacagtgagaccccgtctatacaaaaaattttaaaaattagctgggtgtcgtagcatgcacctgtagtctcagctacttgggagactgaggtggaaggatcccttgagccaggaggtcgaggctgttgtggtgagccatgattgtgccattgcactccagcctgggctaccgagtgagactctgtctcaaaaaaaacaaaaacaaaaacaaaaaccggaagacagcctaagaagacaatcttctttaggatcaataatggtgacattagcaacagctagacttctgttttctgggcttgaaacgccctctgagagggccaggggtggccaagagggtggctgagaccacctcagtatggttgacagtgggagggaagatttggatccagggacacagcccctggcagtttccgtggctgcctcatggtgtaggaaaccccaggagcagcagctgtggtgaggtatgttggggtggagaacatggacaaaaataggtatatggtggcattgtttttaggggaaaatgccaggattcagccatcgtttaggaagtcggaggcctccatagagaggggtgcttgtgtgagcgtgcatgtgtgggtgtgtgcaagtgtctgtgtgtgtgtgatctaaaaaggttaggaatgaaacggggaggtctgagtgccttgaaagccaaggaaattaggacgtgtggaaaacaatgcttcattcgtggatggtgtttggtttcaattcattcatagaatcagtgagtattggctgagtgcagtggctctggcctgtaataccagcaacctgggaggccgaggtgggaggatcatttgaggcaggagttggagactagcctggccaacatagtgagaccccatgtctactttattaaaagaaaaaaacaggccaggcgcagtggctcacacctgtaatcccagcactttgggaggccaaggcgggcagaacacctaaggtcgggagttcgagaccagcctgaccaacatggacaaaccccgtctctactaaaaatacaaaattagctgggcatggtggcacttccagctactctggaagctgaggcaggagaattgcttgaatccagggcggaggttgcagtgagctgagatcacaccattgcactccagcctgggcgacaagagcaaaactccgtttcaaaaaaaaaaaaaaaaaagaaaagaaaagaaaaaagaaagaaagaaagaaaaagaatcagtgagtattcaccaaggctcccagggctaggccaagtactagagctcaggatacggagatgactcagaccaggccccagacacttgcagtctaattgtggagccagacatggaagtgaggaattcaagtatcttgtgagaagtgcgagaacaacagtatctgtaggatgctgtgggaattcacagtccaaagcagccacctctgcctgaggttggcagggagacctcacagaggcaaaactgaggacgtgcttgagggatgaggaagaggtttgaggggaagacagagggtgttccaggcagagggatcagcaactgcaaagctgtggaaatgtgagaccctacacactggttcaggaagcttcagcagatcctactgaaggtggcttatgcctgtaatcccagctacctgggaggctgaggctggaggactgcttgagcccaggagttcaagaccagccttaacaacatagcaagaccacatctctaaaaattcagaaaaaaaggctgggcacagtggctcatgccagtaatcctagcactttgggaggccaaggcgggcgggattgcctgaggttaggagttcgagaccagcctggccaacatggtgaaaccccgtctctactaaaaatacaaaaattaggtgtgcgtggtggcagtcgcctgtaatctcagctactcgggaggctgaggcgggagaatcgcttgaacccaggagacataggttgtagtgagccaagatcacaccattgcactccagcctgggagatgagcgaaaatctgtctccaaaaaataaataaatcaattaataaataaatcagtaaaaaagaaccgggcccggcgcggtggctcacgcctataatcccagcactttgggaagctgaggcgggcgcatcacttgaggtcaggagttcgagaccagcctggtcaacattgcgaaaccctgtctctactaaaaatacaaaaattagccgggtgtggtagtgcgcgcctgtaatcccagctactcgggaggctgaggcaggtgaatcacttgaacacgggaggcggaggttgcagtgagccgagatcgcgccactgcactgcagcctgggcgacagagcgagactccgtctcaaaaataaataaataaataaataaataaataaataaataaatataaataaaatataaaaagtagcattgatgtttacaatatccctgagcggcaggcgtttctcccttttgcagatgctcagtggcttggccggagatacatccaagtggtgggtgtagcctgggggttcaatcctcctgtggcgccccagaacccggtgcctcctccaacgtccggcatctgatgaggatccgacccaggcgggcggcggcgggattcgctcttccccttcgctccccgcgagaaagccccgagggccgcggcggcgcagagccggtgacagttgaagcttaggcgggaagagggaggcgcgaggcgggaagagggagtttgggcctcggcagccgccgtacaaacaccgctctggtcaccatggcaacagcgggatgccgcgaacggcttctgggcggggccggtccctcggacgattggacctagcttggcgcggaatccgtgaattgcccgcggcccgagggtgcaggtgatgggtgctgaccgactggggaagcccggagtgtggggactgaggaggggagtggcctggggcgcgctggagcctgcgaggaaggcgccgcctcggatcccccgccccccattccccttcccgaattccaccctccggcccagccatggcctcagtttccccaaacaggaaagggaaggagggtgggcaccccggtctaacggtgcctctcagcctctgagacccagaaccttccttctgcagctcccggactgactggctctgcccttccccatggacgtaagtccgggccccttcccctctctgggccccctcagcgccctctcctaaccccgaatgggcctgtcttccagcacggactggggagggggcttctacccaacagagactacaacctgccagctcaggacgagagctgtcaggaagagtccaggaatggacttcccacgggagggcacatttctggtattcctggcaagataaggagttgactaagtaatccacgagaaaaggcatttccggcagaggaaacagtctgggggtgagagggaggctgcagcatttggggaactgctagggctatcgtgtgtttggaagagggggagggagagaggtaggcagggctaaattgggaattttgtcactgacataaattttaagtgccaggcgtggtggctgtcgcctgtaattccagctactgaggagactgaggtgggaggatcgtttaagcccaggagctcgaggctgcagcgagccatgatcatgccgctgcactccagcctgggtgacagagtgagacactgtctctaaaaaaattgaccaggtgcggtggctcatgcctggaatcccagcactttgggaggccgaggcgggcggatcacctgagatcaggagttcaagaccagcctggccaacatggcaaaaccccctctgtactaaaaatacaaacattagctgggcgtcgtggcgcgcacctgtaatcccagctactagggaggctgaagtaggagaatcgcttgaacccgggtggcagaggttgcatgaaccaagcttgccccactgctccagcctgggtgacagtgatactccgtctcaataagaataataataataaaataaataatagaaaaagttttaagtgagttactgggagccattgacggattgtaagggagggagggatactacacaaggacatctggtgtggaaaggggcaaaattgcaggttggatgacaggagccggtaatgtgggctgagggatggtaaaggagtggcaagggagtcagagacaagagatctctttggagaggcattccagaaggaaaatcagccctagaagactctagaatgctgaagtgcttgatgttgctgaactgggaatgatagggaaaaaggcaggctcagggcacaagataatgagtcagggtgtagtcctgttgacgctctccccaccatctggtggccgttcctctcccagccacctcctcgtccctcatggtattcccgtgttcctgcagcccctctccatctccttgtcaccccttcctcctgtactcgtccaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggtgaggggtctggtcggggataaagggtgggctctggggaagaggaatcccggtaacctgtcccttcatctgcaggctcttaccctgagacacttgacatttagcccttgcatctatccgttttgtggtaccagggggtccctcctctcctgtccccagccaaaccttttcctttcccctcgggaaagctgccttggctgtcactacctgctgcctattccacatcctgaaccctgtgacctaggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgtgagttccattcctaccccctgccccactgagccctgatctaggtatgatcggtgcattcatttttttgctcaacaacatttattactgagcaccttctcaaggccaggcacggttccagggcatgaatcatgtgcagccaggtaaaaacaacctatcagataatgcctggtgatgaaagctacttgaagaaaataaaatagggtgccagctggagaaaggtgatgtgggtaacatgtagagtacatagccagcacttctaaatgaaagtgagctaaatgaaagttagctaaatgaaaaaacagctcacacagctcctttccgttcaccgaatgaactgtgttctaggtatagggcctctttacggacctttgtttttcccaacaaccctgagaactgagaactaagttgtttttttttctttcctccctccagagctgggtcctcccgtctcctcccctcccctcttcttttctttttgttgttgtttgagacagggtttcactctctcgcccaggctggagtgcagtggtgcgatctaggctcactgcaacctccacctcccaggctcaagtgattctcctgcctcagcctcctgaatagctgggattataggctcacacaactaccatatggctaatttttatatttttagtaaagacggggtttcatcatgttggccaggctggtctcgaactcctgacctcaaatgatccacccgccttggctgcccaacgtgctgggattacaggcgtgagccaccatggcccagccatggttttttttttttttttttttttgagacggagtctcgctctgttgcctaggctagagtacagtggtgtaatctcagctcactgcaatgtccacctcctgggttcaagcaattctcctgcctcagcctcctgagtagtaggaatacaggcgtgtgccaccacgcccagctaatttttgtatttttagtagagacggggtttcaccatgttggccaggctggtctcgaactcctgacctcaggtgatccagagctgggtattttttaaaacctatatgttttttctgattacaaaaagtattatttacaaagtatacatatagaaatacatggaaagtaccaatcactttacaaacccgctctctatcccaaagttgctgtgttttacatgtatctctcatatactaatacagtactatcactgctgtattttaccattatttggcaaaaatggggtggtatcatgtaggttatttcatcatacctgctactgtccccctatcccccgccttttttgagacacgatcttgctctgtcacccaggctggagtctggtggtgcaatcatagctcactgcagcctctacctcctggactgaagcaatcctcccacctcagcctcctgagtagctgagactataggtgcatgccaccacacccagctaatgtttatatctttcacacagatggggtttcatgttgttgcccaggctggtgttgaactcctgggctcaagcgatctgccatcctcagcctcccaaagtgctgggattacaggagtgagccaccatgcccagcctctacttgccctttttttttttttttttgagacgagtcttgctcttgtcacccaggctggagtgcaatggtgcaatctcggctcaccgcaatctctgcctactgggttcaagctattctcctgcctcagcctcccaagtagctgggattacagggatgcgccaccacactaggctaattttgtatttttagtagagacagggtttctccatgttggtcagggtggtctcgaactcccgacctcaggttatctgcctgcctcggcctcctaaagtgctggaattacagatgtgagccaccgggctcagcctctacttgccctttttaacctgacatcacacttcgccacctatccatgcctgtatgtgtagacacataagggttactgtcctcctcctgaagtggggagtaagctggcttagggaagtttagtggcttctccagagtgttacgcaggagagccttgcatcgcaaatagctccacagcgttagctgaggtagaatcctcaggggagaagcctggcttggagaagacaacctgtttctatttgtgggtttaaagatgttaaatgtaatcgaccaccgtcctgaggaatgattattttgagctcagcgattcagacagcaaagcccctgcccttggagtggtgacattccttccctaggatggaaggggaggataaaagcaaattcataacttgggcatatggtgattggtgctaatccctggcatgttttcagttttgaagtaaattgtggggcaaggagcgctttttcagataatcaccttctggtttgccaggggcagtcagcagaggggtctcaggtttggggctgaggggcagaagggcaaaaggaggagaccttgggttctgaaaactcctgtcttggcgtggtggcactcgcctgtaatcccagctactggaaaggctgaggcaggagaatagcttgaacccagtaggcagagattgcggtgagctgagatcatgccactgcactccagcctgggtgacagagtgagactctgtctcaaaaaaaaaaaaccaaagcaaaaaaacctcttgccttagaggagatgctccattagaaaatgatttctggccccctgtcctggggatgccgccccctaccccttctgtctatttgaagtgaatagccagggactcatcacctccttgggagagaggatgggtgaggtgcattgtaaggatagactgggccttcccaccttccccacagagggctgcaagaactttcaaacctggagacatcaggccctgatcctctctggtttctgctggagctaggaagggatttaacagggtggaggacagggcaggttctttctgtccttgagctgtctttccacaaagtatatttaagtccctccctcttcagtttccttgtaataacagcccagaaggttacaaatgtcttgccacttggcagctgtagacactgaggcttacggaggttggagtgacttggaggttatatggctggatcagctggaatagaaacccaggtttctcttccttactgagggagaaacatgcctgctcgcctgctctgcttcttttttttttcttttttcttttttttttgagacggagtcttgttctgtcacccatgctggagtgcagtggtgcaatcttggctcacttcaacctccgcctctcgggttcaagcgattctcctgcctcagcctcctgagtagctgggattacaggtgcccgccaccacacctggctaattttttgtatttttagtagagatggggtttcgtgttagccaggatggtcttgatctcctgacctcgtgatccgcccgccttggcctcccaaagtgctgggattacaggcgtgagccaccacgcctggcctgctctgcttctttcatgtgcatgttgcaaggttctcattcattcattcattcattcattgactcactcaccaaagatttatggagttactgttgaggcactgtctagggccttggggactcagcagaaacaagatggagaaggtccccagcctcgcagggcttccattctggtgatggagagagagaaataaccaggccattacaacagagggtgagaaatgacgtgctatggagcagcggttgctcagccctgcatgcgatcagaagcaggtataggacttaaaaggaaagccaggcatctaggccccacactgaggtctgggctggggctagagtttgtgaatcttttacaagttctcatatgattctgatgcacacaggttaagaaccactgctgagggaagaagctatgataagaatagctctctttcaggccgggtgcggtggctcatgcctgtaatcccagcactttgggaggccaaggcgggcagatcacaaggtcaggagttcgagaccatcctggctaacacggtaaaaccccgtctctactaaaatacaaaaaaaattagccgggcgtggtggcgggcgcctgtagtcccagctactcgggaggctgaggcaggagaatgctgtaaaacccgggaggcggaccttgcagtgagccgagatcgtgccactgcactccagcctgggagacagagcaagattccgtctcaaaaaataataataataataataatatctctctttcttttttttttttttcccaggcagggtctctcttgtcacccaggctggagtgcagtgctccctctgttgcccaggctggaatgcggtggcgtaatctcggctcactgcaacctccgtcccccaggttcgagtgattctcctgcctcagactcccaagtagctgagattacaggcacctgccaccatgcccggctaaagtttgtatttttagtagagacaggttttcaccatgttggccaggctggtcttgaattcctgacctcaggtgatccacctgccttggcctcccaaagtgctgcgattacatacaggcgtgagtcgccatgcccggccaagaacagctctctttcgtccagcactcattacttaccaggcatcgtgcttagttccttccaccgattcccgacaatggccttatgaactaggtcttatattttttcattttattttattttattcttttgagatggagtctcactctgttgcccaggctagagtgcagtaaaacaatctcggctcactgcaatctccatctcctgggtttaagcaagtctcccacctcagcctcccaagtagctgggaccacaggcgtgcgccaccatgcccagctaattttcgtatttttaatagagatgatgtttcaccatgttggccaggctagtcttgaactcctgatctcagatggtgcgcccaccttggcctcccaaagtgctgggattacaggtgtgagccaccacacctggccttaggtgttatattcctataaatgaggaaactgaggctgaaaaaatgaattagccaagctgaggttcaaacccaggccttactgactctagggcctgagctttaaccatctatacgatgatggctggctctcacagagacaacaggaaaaattcaagtgaaaaactctcctgagagccaggagagacacaagggttaacagtcttgcggagtccttgtttaatgtacttaaacagcagattccttccagaagccacatggctgcttgtaacggttgagaaatccattagccagttattaatgacaagatctaaacccttccaagggagagagccaagaaatgcttttaataccctcttttctgaggtaatggcagcagagcctctctcagccatgggttctgtgcacagaatgatggtgtggtccttcaaaagcccgcagaagtgatttcatccccagactgagactccctagagacaccccaaatcacaccctcatcaaacacaagaaaatcacttctctctcccccttccaccatgacggttctagcctcccccaaggaggcagttctgttgacagtagcacagcccaattcagacccctgtccctgcaggtggcaggtcccctcccctcactgcagcccctagtgatatctgatctcaccagccatctgacaccacaccctgaaacctcagctgttggaaaggtcattcccctattcctggcttggccaagtttctgattgaactgtacaactgtgactgtcactacctctgcctctggcctcaaggagccaatcttctgtcacacagccatcctgggccacttcagccatttggcctgactccagcccatgcctaaggcagttgcgggtcatccctgtcccaggggaggacagcagtgcactggatagaccagttctcccttcttgtctctaaggacacgctgctcctattccccaaagagacagacattgtttcctccaggagctgagaagccctcttctttcttctttgcctaaagaaggcaaatgatatgcttagattcatccattcattcagcattcatttatatctcagacacctgctgagcatgagtccagtgctagctcagtggagaatatgggatgagctgcccctgccctggcagacccagagagaggctgatgctcctggcactgggaggcagagggctcaagagggattgcaggcaggactgtacatcccagctccattcccatcacttgcctctctgtctatgcctccatttcctttttttttttttttttttttttttttttgaggcagagtcttgttctgttgcccaggctggagtgcagtgggtcgatctcggcttactgcaacctctgcctcccaggctcaagcgattctcctgcttcaggcttctgagtagctaggattacaggtgcaccccaccacgcccagctaatttttgtgtttttagtagagaagaggtttcgccatgttggcccagctggtcctgaattcctgaccttaagtgatccgcccaccttggcctcccaagttgttgggattacaggcatgagccaccatgtctaaccatccattttctcttttgtaaagaagcccattactcaggattctggtaattaaaaaatataaggctgggcgcggtggctcacacctgtaatcccagcactttgggaggccgaggtgggcggatcacctgaggtcaggagttcgagaccagcctgactaacatggtgaaaccctgtctctactaaaaatacaaaaattagctgggtgtagtggcgggcgcctgtaatcccagctactcaggaggctgagacaggagaatcacttgaacccgggaggcagaggttgccccaagctgagatcccaccattgcactccagcctgggtgacagagcaagactccgtttgaaaaaacaaacaaacaaatagatctaattcttttgaaaacattaaaattgattgggcgcagtggcgcatgcctgtaatcccagcactttgggagaccaaggtgggtttagcccaggagtttgagactagcctgggcaacatgatgaaaccctgtctctacaaaaaaatacaaaaaatgaattagccaggcgtggtggcacgtgcctgtaatcccagctacttgggaggctgaggcaggagaatcgcttgaacccaggaggcggaggttgcagtgagccgagaccgcgccatggcactccagcctggcaacagagcgagactccgtctcaaaaaaaaaaaaaaaaaagtacaaaaaatgagccgagcacggtggttcatgcctgtaatcccagcactttgggaggccaaggcgggcagatacctgaggtcaggaattcaagaccagcctggtcaacatagcgaaaccctgtctctactaaaaatacaaaattagccaagtgtggtggcacatgcctgtaatcccacctacttgggaggctgaggcaggagaaccgcttgaatccagaggtggaagttgcagtgagtggagatcacgccattgtgctccagcctgggcaacaggagtgaaactccatctcggaaaaaaaaaaaaaaaaatggccgggcacagttgctcactcctttaatcttagcactttgggaggctgaggcaggtggatcatctgaggccaggagttccgagaccagcctgaccaacatggtgaaacccccatctctactacaaatacaaaaattagctgggtgtggtggctcacgcctgtagttcagctactcagaaggctgaggcagaactacttgaacccaggaggtggaggttgcagtgagccaagatcgcaccattgcactccaccctgggcaacagagtgagaccctgtctcaaaaaaaaaaaaaaaattaaaaataggtaaattgccattttcaaagatacctgtaaagatttttaaaatcattcatgaatgcggtctgttcgttgcacagagtagatgctcaaaaatggtgaatgagaccctctattttggtctcatgctgaagaagtccataaagcccacaagtcattttcatgatggacagaaaaatgtgtgtgctttctctgtctactgcctcaactgcacagaccccgggactgtagcagaaccatcttttgagcttgacaccgggaggcccaaattctagcacgggacccagggccagttgctctctggtcctcagtctcctcacccataaaatgggaaggagagaaccctgaatcattgcttctagcttctgaactcagttgttcagaacaaggactcactgctgatttttcaacagcacagggaattgcactgttcctgggaatgatggacagtaccctctgttccactgggcaagtgagatttcccaggcctctctgttcccttctccccttagagagcaacagacgtggccccatcccacctccctcaaccctctctctcctccctcaggactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtgagtgtagtgccagtatctactctccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggtgagtgggcaggggctccctccccatcaatagggccgacccaagtcttcctcccccttcccccatgccgggccccacgatagtgtgaatgtcaggggcttcaggtttccctaaatataggtccctgccagaggatccgtggcgggaaaagggcaggggtcattagagaagatcggggacacatgtggggcgggcaggagctgccttataaccagcccgggaacccctagctcactcgctgctgaccaggctctgccggctccttcggcctcgccgcaggtgggccccttgcaggaccgggccggggtggggatggggttggggttgggccaacagggtccagatggggtccaggtgaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggtagcagagcccagaagaagaaagagcccctgttctctgttttttctgggcagaaaaggagtgaaaggtggaaggaccttcctgctctgttttatacttggccagggcttcaagaaaggctgagagcttgtgacattttcttccagccactgcaggctctgccccttcacctaacagcataagatagggctaacagttggggagtatggttgtaactgctcatgtcttaggaggcttcagcctcagcacttttaggtccagaactcaaggggggcagaagacccctgtgacaaaaacccactaactagctcatgagtgacatgagccaggcaacataatgggtgttttatatgagtagatgctgttatttttaatttatacctaaggctcttttgcccaagattgaactgtttcttggtggaaaggattatcaatgcatatctcttttttttttttttttgagacaatctcactctgtcacccagactggagtacagtggcacgatcttggctcactgcaacctctgcctcctgggctcaagcgattgtcctgcctcagcctcccaagtagctgggattacaggctcacgccactatcgcctggctaatctttgtgttttttagtagaggtggagtttcatcacattggccaggctagtctccaactcctgacctcacatggttcctccacctcagcctcccatagtgctgagatgataggcgtgagccactgcgcccagccaatgcttatctccttaatctacactattgagttttctgttttcccatctttttttttttttctttttgagacagtttcgctcttgttgcccaggatggagtgcaatggcacggtctctgctcactgcaacctccccctcccgggttcaagtgattctcctgcctcagcctccacagtagctgggattacaggcgcaagccaccacacccggctaattttttatttttagtagagacgaggtttcgccatgttggccaggctggtctcgaactcctgacctcaggtaatccgcctgcctcagcctcccaaagtgctgggatgataggcgtgactgcgcctggcctgttttcccattttaacaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatctctgcagtgattcaggtagaacggagttacctagaaccttctaggagtataaaaacttggtcctaggccgggtgcggtggctgacgcctataatcccatcattttgggagaccaaggtgggcggatcatgaggtcaggagtttgagaccagcctggacaacatagtgaaaccttgtgtctactaaaaatacaaaaattagccgggcatagtggcgcacacctgtagtttcaactacttgggaggcggaggcaggagaattgcttgaacccaggaggcagaggtaatggtgagccgagattgtgccactgcactccagcctaggcaacagagccagactccgtcccaaaaaataaaaataaaacttggtccttcccttttctgcttattttgcttttattgcttacatctaaaacaaaaccaatcactattatccctctaaactttggattaatttgtctgcctagctcattcaactctgggaaacaaacactgaagtaaagcaaataaaaattgaaggtcggtagaagatggcaaagggggcattccaaaagggaacatgtgcagagtctcagagactggagagattgtttaaagatcaatagtttcagccgggcacggtggctcacaactgtaatcctagcactttgggaggctaagtccggcggatcacgaggtcaggagttcaagaccagcctagccaatgtggtgaaacccccgtctccactaataatacaaaaattagctgggcatggtggcgcgcgcctgtagtcccagctactcgggagactgaggcaagaagagtcgcttgaatctaggaggtggaggttgcgctgagccaagattgtgccaccacactccatcctgggcaacagagcgagactccgtctcaaaaaaaaaaaaataaaaaagactagagaagcagagaacgtcatataccagtttgggggatttggacttttatttatttatttattttgagacgaagtctcgctctgtagcccaggccggagggcagtggcacgatctgggctcactgcaacctctgcctcccgggttcaaaccgattatcctgcctcagcctctccagagtagctgggattacaggtgcacgctactgcacccggctaattttttgtatttttagtagagacggggtttcaccatgttggccaggctggtcttgaacccccaatctcaggtaatccgcctgccttggcctcccaaagtgctaagattacaggcgtgagccaccatgcctggcctggacctcttaattttatgataatctgagttcccgaaagagtaattgatagaaaaaaaaactacacctgaggacacaactttctgagttcaaatttctttttttttgagacagcatttcactctgttgtccaagctggagtgcggtgtcacaatttcggctcactgcaacccccgcctcctgggttcaagcgattctcctgcctcagcctcccaggtagctgggactacaagcgcatcaccaaacctaattattattattttttattttttaggatagacagggtttcaccatgttggtcaggctgatcttgaattcctgacctcaggtgatccacctgcctcggctgcccaaagtgctgggattacaggtgtgagccaccacacacagccaggttcaaatttctttcttttttttttttgagacagagtctcgctctgttgcccaggctggagtccagtgacgcaatcttggctcgctgcacgctctgcctcctgggttcacgccattctcctgcctcagcctcccaagtagctgggactacaggcgcccgccaccacgcccagctatttttttgtatttttagtagagacggggtttcactatgttagccaggatggtctcgatctcctgatctcgtgatccgcccgcctcagcctcccaaagtgctgggattacaggcgtcagccaccgcgcccagcccaagtttcttattctttttgtttatagactgggtctcactctgttgcccagcctggtcttgaactcctgggcttaagtgattcgcctcggcctcccaaagtgctgggattacatgcttgagccaccacacctagccccggattcaaatttcagtgtaacatccccaatccactgttatacaagcaatgaacaagttatttaacccctctgagccagtttcctcctcttaaaaaaggcacaaaacttaatagaaagcaactaagaagccaggcacggtggctcaagctggtaatcccagcactttccgaggccgaggagagtggatcacctgaggtcaggagttcgagaccagcctgaccaaaatggtgaaaccccgtctctattaaaaatgcaaaaattagctgggcgtggtgacgggtgcttgtaatcccagctactcaggtggctgaggcaggagaattgcttgaacccaggaggcggaggttgcggtttgccaaaatcgctccactgcactcccgcctgggcgacaagagcaaggaaggctctgtcttaaaaaaataaataaatgaaaatacaaaaattagccaggcgtcgtggcacatgcctgtaatcccagctacttgggaggctgaggcaggagaatcgcttgaacctgggaggcggaggttgcagtgagccgagattgtgccactgcactccagtcggggtgaaaaagcaagactccgtctcaaaaaaaaaaaaaaaaaaaaaaaaagaggccgggcacggtggtacacgcctgtggtacagcactttgggaggctgaggcaggtggatcatgaggtcaggagatcgagaccatcctggctaacacggtgaaaccccgtctccactaaaaaatacaaaaaaattagccgggcctggtggcgggcgcctgtagtcccagctattcaggaggcagaggcaagagaatggcgtgaacccgggaggcggagcttgcagtgagccgagatggcgccactggactgcagcctgggcgacagagcgagagagtgagactctgtctcaaaaagaaaaacggaagcaactaagaaatgtcaagagtgccattttggaatcagagaagtcatgctgactgaggcacaggcttggcgtgggaaaagtggactccaatctgttaacttctgaagttgtccacggcaaatatttctctgacggcacaggaagagatctgaacttggcttccctcatccattgaacaagtattaacaagtatctatatatgcctaccgtgccaggccttattctaaccactggggctgcaatatttaaaaagacaaagttggatcctccaaggactgtggtggggaaggctgacaaaacaagtaacaaaaatgtgtaacattaaaaaaaaagtgtaatgttaaaaaaaaaaagtgtaataaagttacaaagcctagccccagctcggcttgtttccctagctgaaatgggggatggccgggcgcggtggctcacgcctgtaatcccagcactttgggaggcccgaggcgggaagatagcttgtgcccaggagttcgaggtcacagtgacctatgatagccccaccgactccagcctgagcgatagagcgagaccctgtctctaatttagaaaaaagaaagttgtggccgggcgcggtggctcacgcctgtaatcccagcactttgggaggccgaagggtggtggtgggtgggggcgcggatcacctgaggtagggagttagagaccagcctgaccaacatggagaaaccccgtctctattaaaaatacaaaattagcccagcgtggtagcgcatgcctgtaatcccagctactcaggaggctgaggcaggagaattgctggaacccgggaggcggaagttgcggtgagccgagttcgtgccattgcaccccggcctgggcaacagcaaaactccgtctcaaaaaaagaaaagacagttgtttaaacatttttatgaaatgatatgggaggggactggtctagggtttctaatagcctccacatcgcccagcggcagagcccacaaaactgccactggccgccaccgggttcctccacctccttcccgatctcaggctggagaagtggtgcaggggtcgctgcgaaaggagaggagcgtgtatgacgccacatccggcgcgcggcggaactggcctcctttgcttccgcggcggggccggaagtaggagcggcggcggcggcggcggcggcggtcgaaagcggagtgaaagagggaggcagggagccggagagccggaaccggagtcgcagcggcggtaatagtgcgagactcctctaagtcaccgtccttagcgcgggaccgcggggttcgacgggagttagcgggggtgcggccaggccgttggacgccggggggtcctggggccgatgtgaggggaggcgggggtgggggagccgggccggctctagaatcgagttgtccgctccgagccccggacggacactgatccgcgggctcgtcttggcctttcccaggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtgagctcgttggccctggggaagggaggccaagccgccgcccacgggttctggcctggggcaaacccaactgagaactttgggcttgcctcgttctggaagctttcccagagaggagcaggatggagccgctgccctcgaggaaaagctagcctgctcggggaagacagagtggataaagacacttaaagtttattagacgatgtgtttccagtggagtaagagtgttacataaagtacttaggaaactcaaggaaacaagtccatctgtcgggggacggaagcttgttggaggggggccgaactgtgggagaggcctcgaataaggaggtggtaaaagagtcagccaaaaaccaaaagtttaagacaggaaagttaaagaccctgtgatttataaaagtcttctaattacaacaacccttaaagattggtggtattgtactcattttacaggtgggaactttcatgttcaaagttacccacaagtaaggaatggggtctgaagccagctcttagtgtcctgtcctttttcaggccataatgcaaaaaggtggagttggatcattcacgttcagggtgggagcctgagaaatcgtagcaagtaagccagggtagaattaagcacgatagggaggccagttcagagttctgtgggaagtaggatgatgtagtggttaaggctctaggttttgcagtgtgagatggctctaggtttgaatctgaactctgccgctttctagctgtgttagtaatcttaagtgtctttatttgtaaagcagaattaatagtacttaataagatgattgtgaagattcagtgagttggtgctggagatgaggttagcacagtgttttggtacagcatacgtgcttgataatcaccaggtattctatttcttttggaagagggcaataatgagatgggctaaagccatcagggagggcttttgagtggaggtaggccttgaaggatgaagataatttggctagctgatggaggcagggccagtgagggaagggcattccaagcaggacgaatgtaacagtggaggccctgagatgcgtggggaacagtcaggggtttaattacctgcctcctctggggaactgtgtgattgtggcttctaccaggctggagaattgtggcagaagagcccacagaattaccctacgtttattgaacagtaaacattggcctttacagggccactatttggcctggcccggtactggcaaaaaacttctatccatctcttccccccagcaatcctatgaggttggaatcatttgctgcattttatcgaataggaagccatgactcgtagaggtctggtgacttaactgaggtcacccactgaggacgtggcagagctgggtcctgaatctgtggccctcaggctctttgcctggccctgcctcacatagactacctgcagccagacagggcctgtgaggggatgatgagcagggtcggcctctttttcgccacctgtctgtggcttttctcttttgccagctgaccagaccagccccatggtgtttttagttgtcccctttccctcagtcctgattggcatttttaggaacttaaacctgttgttgcctggcactattctttaacctcgaagtattgtctccctcacgggccctggatcagtgtggtggtgatggtagacaaagcttagatagcatgctggagtttgcagaatagcaggaagtcgtatattcagtctccatggctccttgcaacagcctaaggaatacgcagggtgggctgagtacttagccccatttcatagcagaggaaactgagcctttgagtagataatgtcttgcccaacatcacgcagctagtcggaggggaagttagttttgcatccaggtctttgactgtgctccgtggtcactgagagccaggcagaggcatttagattttgatgtggggtgtgaggcagcaggaagccatggaaggctgaggggtggagggtcctgcccagttgaaactgagtggaactaggaggtactaggccaaggcctgagttggccgctgttgtcccaggctcagtctgaagcagggccatctctgatacctggttatggcctcctggggacccatcagagacccaggctgaggctggtggtgtcaagagcaccagcttgcctagagggcacagacatgcagatgaaaccagtggaagcacagaggtccgcagtgtctgagctgaaattgctgctactagaaatattagcacagtaggagagctgagcttttgaatcaggtggtcttcagtatgaatctttgccttgtcacctagaagcaatatgaccctcgtcaagtcactttctgattttttgaagtgataatgacatgcagttgagagtccgggtatccgggcacagggcctgctgcgctggtagccgttactgcaggcaggtcctgatagggctggggaagtgctgcaagtggcagaactggggctggaatctgggcctgattcccaggccacactggggttgcgctggcactgaggggggctttgcagagagcacgggccctgcatgtgacctccctgggcttcaggttttcactcagggtctgtggaaggggctggcataaattctcaggaaattgggcttctgggttccaatttagccactctccagcttggtgaccttgaccctcccgcttttctgtaagctttggtttctttttttctttttttttttttttgagacagagttttgctgttgttgcccaggctggagtgccagtggcctgatcttggctcactgcaacctccacctcctaggttcaagtgattctcctacctcagcctcccaagtagctgggattacaggcacgcgccaccatgcccagctaatttttgtatatttactagagacggggtttcaccatgttggccaggatggtctcaatctcttgacctcatgatctgcctgccttggcttcccaaagtgctgggattacaggcatgagccaccgcgcccggcctagcttcggtttctttactgttacgtgaggctgaagagaacctccccagtctgttggaaaggtcactatgagcagttgatggggaaggatgttcagcacaagaagcagtgcaggtgggagagtccgggtactgatgtggcctcttggaccaccgccagtgctgccttctgttcccagaaagccagggcagacctccttcgtgctgcctctgccatacagagcaaggggcataagtgaatcctcctgtccactgagctcaggaaactcattctaagggaagagattggcagaaagaggggggccaggcgagttgggcctcccacatcagaatatcttgataaagagtcagaccccagagccaggcttccctggttcatatcccacctgtgtcactggcaccaagccagcctccttccctgcttcaatttcttcatctgtgtaccgggaatcatcatagtacctgcctgccaagctcttaataacatttgtggcacacagtatgagctcgaatgttcactgctgctattaccaggcaaaatttggaaatacagtgttgcttaaattgggtatctataggctgggtgcagtggctcacatctgtaatcccagcactttgggaggcaaaggtgggtagatcacttgaggtcaggagttcgagaccagcctgggcaacatagtgaaatctcgactctactaaaaatacaaaaattagctgggcgtggtggtacatgcttctaatcccagctactcgggaggttgaggcaggagaatcacttgacccaggaagcagaggtttgcagtgagcaaagatggcgccactgcactccagactgggcaatggagccagactctgtctcaaaaaaaaaaaaaaaaaaaaaaaattgggtgtcttacctggcaaagtgatttcatctcctgctcactcaagtagaagtagactgcactgcaaggagaaataaaaaatatttaagtcctcatagtcataaagaaatactgaacacatggcaagagcacctcacttttttttttttttttttgagatgaagtcttgctctgtcgcccaggctggagtgcagtggcgcgatcttagctcactgcagcccccacctcccaggttcaagcgattctcctgcctcagcctcccaagtagctgggattacaggcacgcgccaccacgcctggctaatttttgtatatttagtagagacagggtttcaccatgttagtcaggctggtctcaaactcctgacctcgtgatctgcccaccctggcatcccaaagtgctgggattacaggcatgagccaccgcacctggccaagagcgcatcactttgaaggcgcatccactgtgggcctgccctgggcacctacccttgtgtctggatagcctgggagaagggctctgtgattggccaagggtgacttaagctctgctgtggagaggatggggagacccgcctcccaggagtgagtcctggatgcggaagagggagcggcagggggagtcagggctggaaaagtcccagcctgctcagaaggcctggaacgctgggataagaggttggactttgtccttttggcagcagggggccacggaagggtgttgcatgctgaagggccgtggtcagcctgttttggggagactgtacgcttcactcctgccccctggagcttccaggactgcctcatatcctcccctccccccaaaaaaggtcaggaattgggctgggctggcctggctgtggtgaccctggtcttctcctgtctccagagagatcttggtagaggagagcaacgtgcagagggtggactcgccagtcacagtgagtacctgctgtccctgcagagccaggcctggtctttcaggcacatgaagtttcctcttcatcttgggggctctataagcccaaccctaagctcttttatctgtcctttccctcaccttcaacggagcactgctaaaagaagtgggggttgctgtgcacgttggctcacacctgtgatcccagcattttgggagggcaaggtgggcacatcacttgaggttaggagttcgagaccagcctggccaacatggtgaaaccgtttctactaaaaatacaaaaattagccacgcgtggtggcacgtgcctgtaatcccagctacttgggaggctgaggcaggagaatcgcttgaaccccagagttggagattgcagtgagctgagatcaggccactgcactccagcctgggtgacagagggagactccgtctcaaaaaaaaacaaaaaaaaacaaaaaaaacaggccgggcgcggcggctcacgcctgtaatcccagcactttgggaggccgaggcaggtggatcatgaggtcaggagatcgagaccatcctggctaacatggtgaaaccccatctctactaaaaatacaaaaaaattagccaggtgtggtggtggacacctgtagtcccagctactcgggaggctgaggcaggagaatgacgtgaacccaggaggcggagcttgcagtgagccgagatcgcgccaccgcactccaggctaggcgacagagtgagactccgtctaaaaaaaaaaaaaagaaaggaaagaaaagaaaggggttatgggaagggactttggatttgttagtggagattcttggccagggcagaaggactcctatttggcgagtgattctgctcacatatctccagggctctgtgttagtaacttgattctgggtactttgtggggagtagagagaggaaggggccgggacatctacctggaaggacttagttctagctcttgcctacagaatagttggtactcagcataggacagtgggtatggttccagaccagactgacttggggtgggagaggagaattttggtcctaggaagtagaagtgcagccaagagtgataaagctcactaaagcagcgggtgtttggagggtagtccctggcaactcccactgcttgagttccaaccccactcttcctgttccccaggtgtgcggcgacatccatggacaattctatgacctcaaagagctgttcagagtaagagtgtggccaacactgtgaaatgtaacggggggatgactggaagacccctgtaattgagggtgggagccttaatttggggcgtggagtgggggcaaggggccccaagttagatgggtggttgtggaagaagggcctccgctggacagaaacaggtagggggtaggggactgtttacgacagggcaaaactttctacttccccacaggtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccacccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaaggtaagccagcccagggctccatgggacagggagaggaggggggcttcaggcctcagccccgtcctctttccctgctctcccctgtagatcttctgcgtgcacgggggcctctccccctccatccagaccctggatcagattcggacaatcgaccgaaagcaagaggtgcctcatgatgggcccatgtgtgacctcctctggtctgacccagaaggtgagggcatgtgggcaggggcaggcagggacagccaggaggggttgggaaagagagggagcagggctggtcttcactgtcactcgtcctccacctgccaaatggctggaaccctggaggaggagcagggaggcctgcatggcaggtgctttgagcacacagtggcttggggcatggcccagagggctgtggaggacaaccaagtcatggctccctgaagtgaaggggccttagaacatgacagcagcttcttcagaggtcagaaccccagaatggtagccccctgagacccctcattttgtgggttttccactagtgtagagcagagctgagatttaaagtcaggtcttctgaggaccagccagagttcctgttgtcacaggcacacacgcacaggcagcctctgctccagcgcagacacacacacacatacacatagcctctgctccatcacagccacacacacgcacacgaggcctctgctccatcacagccacacacatacagacacacacatgcagacacacacatgcagccgctgctccacagtcactccggacctccctgtgacaacacagggtgcccttctgtctctgggagtgcccctttcactcttatgtgctgtttggacggggattgtatgatcactgtgattatgagggggccccaggcattgggcgttctttctcctctggagcttatctgcccctacatttgctgtcctggtccccgccatcccacagaccatattcaggccccatgctctggtcccacgggcctctggtggacttggggaggggccaggctgctcaccctcaaggggcagcgctggcagccagagaagcctgaggacatccctctccatccctccctttccgcatcagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccggtgagccggctgggccgggctgggatgggcgggcatctgagccgagctgctcctgaccctgctgccccgccttccagctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtttttgggtttgtgccagacttggttgggaatgcacagggttgctggcctgggacctggggtggacgtcagggccttgactgcctcagggccccgacctgccaagagggccaggctcaggccagtcagcttgcccagggcctccaggggccgctgcctgctggcttccccagccctagggagagggctctgttctcatgggcagccttatcttattaacagcatacacacacaggcacacacagaatcacaggattctgatttctccattttcctgaagaggagatgggcctagagggccagtggattttgtgctaggtcaggcagctggaaacacaggtctagatctgggcctgggtctcctagcaaagcctttgctcacccagccccgcccagggccaaacacaggagcccaatgtttcctgagcatggatggcttttgagttttattaacaaaaatactctggtcccagaacaacagactggtgtggcctgcaccagtgtgtgtgggggggtggggattgagcccctccagagcccatggggaggcctggtaagtggggatgctggtctgtggccccatttggccaggcagagccccttccattcacacggaggtgagagccgggaaggggaagccggccccagctggactcccagcagccttggttaggctttgaagccagaggggggtgggagtgaaatcaaggtgtgaagttgagggggtgggtgggcaggcccaaggcggccatttggtgtgggggatggggccggtggaggtgagggggctccagggctgggggaagggagcgggaggtttgtgatggaggcagaggggcccagcagtggttcagtacatgggtttggagcccacatccagatagcccccaggcgcggtgtatggtagagggaaggggcccccttggagaaagtgcggggcaaagggtaccgccggtggagccgctgggtacccggagccccctgacccgtgcggcagctccagaaatgcagccgagtagggggctgagcgcccggagtctggagcctccgggaagctggggctcctgacatggagagagggatgtcagagcagggcagagggacccgcagccccgcctggtcccctgtcccactcacctggtgggaaggtgactgggggccccatggaaagccgcagggtgcaggaggtaggcctcagcactggggccaccacacagaggtgccggggcagcggtggcttccccgggggctggggcctgttctggatctgattcacgaatgtctccacccagggtggagtcgcagggaccacctggtgtgtctggggagagggaagggagaggttgggctagggaggatccctgtctcaggcctggccccatcgccatcgggactacactcacctccgctcccataggcctctgtggctgctggctctgggccccgcagtttcctcttcacacgggcgtctcgctccctggggaacagtggtggtgatgatgatgatgatggtgatggccatggtgatggtaacagtacttacccggtgccaggcatttcaccctcccagggaccctgtcaggtaggggccatcattatacccattttatagatgaagaaactgaaggccagaaaattaaataactagaaagtggcagagctggaattttgtccctgctcaaatttgtccatgctttcctattgtgtttagtatcagtggaaactccttcccagtggcaaggccagggcacagtctcacctagctcatctttctgccccatctccactctcagcctctctctggaatcctcttctgtcccctcttcacgggctgaacctgtcctttttcttttcatttttaaaatttgagatggggtcttgctatgttgcccaggctggagtgcagtggcacagtcacaggtcacagctcactgcagcctccaactcctgggctcaagtgatctttccatctcagcctccgaaagtgctgggactacaggcatgagccaccaaacctatccttgcctcactgcaagcgcaagttcctcaaggaagtcctccctgacctccgagagcacacacccctccctcataacatccgtcacagttctgcttttgcatttgatggagtgactccttggttcatgtctgtctcttctgacaaactggaagctacttgagggcaggggccagctctgaggtgctgcacttggaacagttcccacggccttacggaacctttactgtccgacataacctggcttcccctcccctgcctgactcttagtcactccactgcagccacgccacaggcacagccccacctcagggcctttgcacgtgctgttcccactccctagtgtgctttgccagatgcccacctggctccctcccgtacttccttcagctctttctcaagtgtcttcttcccactgaggcctttccaggcctcttatctaatacctcaccccagtccttcctatcttttcctggtttatttctcttctcctttttcttttttttctttttttttttttttttgagacagagttttcttttctttctttttttttttttttttgagaggaagttttgctcgtgttgcctaggctggaatgcaatggcatgatctcgactcactgcaacctccacctcctgggttcaagagattctcctgcctcagcctcccaagtagttgggattacaggcgtttgccaccatgcctggctaatttttgtatttttagcagagacagggtttcaccatgttggcaggctggtctcgaactcctggcctcaggtgatctgcccgcctcagcctcccagagtgctgggattacatgcgtgagccaccacacctggtctctcttctctttagaatggcttcctaacagatgacattttatttatttctcttgtctgcttgtctactctccccactagaaatcagctgcatgagggccggggctttggtttgctttgtttgttttatctccagtgcctggaactgtccctggcacatagcaggtactatataagtatttgctgagtcagtgaatgaatgttttcacttaccactgcatttctgatgtccagcacggtgcctggcacacagtgagtgattaataaacatttgttgaatgcatgaacaaatgaatgaacaactcccacctcttacagtttctgccgttctcccggaagcctttggcaaagggattggctgcaatcttcagttgtgtgatctggggacacacatgcagggtcaaagcaactgcggtctgggcagggggccaccaccccctcaagcagggtcactcacctgtgggttctggtaggctgtcacggagatgaatgtggtctcggggaagcggaaggaggccatgcccccccagtgctggctgcagagctgggctgcccgaactaggtgtatgcggggttggtacttgtgcatggagtgcaggatcagctgggagggaggaaatgggagtgattccctgccctgcgcctcacccttggcctcccttccagcaccccccaaccctatcctggagtcccagcctgggcctcacgtggccgtgggggtccagcgtgctgttggtgagcttgacacgatggaaagacacaggctgccgcatccaatgtgcaccagtggcaggagagtcggggtgaatgtagacacggtcaggcaggcggggctctgccttgccgctgggctcccagcgccggccctgccagcggtagcgagccccatccaccggaatcacatccagaagaaacaagtagcgggcctcggggtccaggccagtgactgacactcggcaggcagggaacatgcgcctgtgcaagggaggggacaggagaggcctggagctacccactggccaggggtgggcccagcaccagtaacgggacataacaacgggctccccagagctgtcagagaaacatcaaaggaggtggaattagaacccagagggcaggctggaggctgtggctcacacctctaatccctatactttgggaggccaaggtgggaggatctcttgagtcaggaattcaagaccagcctgggcaacatagaaagaccccatctctacaaaaaaattaaaaaattagccaggcatggtggtgcacactgatagtcccagttactacagaggctgaggcgggagggtcacttgagcctgggaagtcaagactacagtgagccacaattgcaccactgcactccagcctgggcaacagggcaagacactgtctctgaaaaatgaaaaagggccaggcgcagtggctcatgcctgtaatctcagcactttaggaagccgaggtggaaggatcatgaggtcagaagtttgagaccagcctggccaatatggtgaaacaccgtctctactaaaactacaaaaattagccgggtgtggtggtgtgtgcctatagtcccagctactcgggaggctgaggcaggagaatcgcttgaatccaggaagcagaggttgcggtgagctgacgagatcgtgccactacactctagcctgggcaacagagcgagactccatctcaaaaaaaaaaaaaaaaaaaaaaagaagccagagggcggaatcttagagctggaaggttttcttgtctcattttacatttggggaaacaggacagacgggttaagtgatctgtcacacagcaggttaggaacagagccatgactcctacccctcaaagcctatttgcagaagcaggggtgactaactttcttgctaggagcttcctgtccccaccctcctctcctcccctgatctccagcaccagaatctgcagctcttagatgaatttgctttagaaaaaatataccctgcctgcagtagggccgaggactttccatgctagggcttgagttcctgccccagctaaagacctcatctaaggtcaaacactgaccgtgtccctgcctctagggtgaccctggacctagtcatatactgactcctattcgagttgcatactgatcccgaatcctggccagatttccctgatgctggtcaatgggctggcccttgaccccctgtccttgtctggatgctggtctaagccacacactaacctataacccagagggacttcctgaccctgccccagactgacccatgacccttgccatagattggtccctaaactcagccacagactccacagactggcccttaacccttgtcacagagtgactcctgattcctgccacagagtaacccttgccccaggccatagtcagattctaggcctaggcagagctctagcccctcgggaaccacccagtcctagccccctccccagggactctgcctttcccaagagacccccaccagaaacacggaccctggccagcccctcacctcccagctttggtgatgatcatttctgttcccacagagctgaactccttccatagctcccggttctccaggctcaggctgacccccgggagggaatggagggcctctggagctgatggggccggctcagtgcccatggcagggggcagaaggggcagaggtgggtgcgcggccagggtgcggggagcagcctccatcccggagaggaagcaatccagtttaggggtgtccagttctggaagccggggaagaatgaggagccagccgagggccacagcccccctattctcctacccaggagctggtcccaacgctcaccggggtagcggtagccctccgctagggcgggtgggaagctggagtcggccccaggttgggcgggccccaggcggtagccggcccccagggacgggtacaattctcgtggatggtacatgttgtagttccgtctggcctcaggtctcgctgcttagggcccccggtgctgcgagatgccccctttatagctcacagctcagccccttccagatccaggatcacagcccctcccctctttggggccctggagttgggctggggtggagacccctggggcctcgaaggggtccgagagggggtcggatacctgggtacggtcccctcctcccctccctccccaccccgggaggcttcattagcctcgaccccctgccccctcattacataattaactcctcggcttgattgatccccagggctcggacagggacgcagtttggcgcttccggccagctggtccccgttcccacggtggggagccccggctagggataagctggggggcggggcctggaacctggacggagccaagagtcccgggacacaccttggcgccccagaccttctggcaggtgaccgccctccgccccccttcacttggaggccgggccctggagggaagcagcgtgaacagagggaaagtgcaggctagagggacgcggcctgagctgatttcacagggcactcggggccgcgaggaggccgcagcccagtcccgagcaccgtagtcctccctggtccccatgctaaaaaaacctccatcccgagccaagcctccaaagttcgaaggcgctcacagtccgacagcttctgacgcctcgcgccagggtttcccgaaggtcccgcgctggggaaccctcggaactacacttcccggcaggctcagcgctgaggcgcgcccgaaggagccggacggaccacgcgggggccgctgggagttgcagtccgaccgcgagggggctgcgaggccggcggcgcggttgcctccctgggacgctgcccctaggcggcggccaaacgctgcagatgagcagacgcagatcagccgaggtcacggcgtaggcagccagagtgggctcaggacctccgccagcagtgaaaccgtcccggttcccggagacccagcttggacggctgtgcctaccccatgccccgccggggctcagaaccgcacaggtctataggggcggaaatctccgcttgagctcccccttcccggattacacgcgagcctgagctgtctccactccattgttttattatgtacaaacgctacagaacgagggggacagacacgcgtggggtaagaagggcctggtgggaggagttcacagagcagacggtgcactgggaccaggagagcagaacacaggccataactatagggcaggtggggcaggaacgggttaaaaacgagatccaagccagccagatcgcaggaggtgcgggggcgtcgtcccccttctgttctccccccaaggtcacagtgcatgcaataaaatatatatacaggagctagatccgtcctctgcaggggctctgagggtccagagctcccttcgggtggcgggaagccagtggcgctccctggcggccaggccgggctggagccacatgcgtcgggggagcgggggtcagtcccagccgttgtctttgatcatgtggttgagttcaatgatgtacttcccctctttgtacttctggctgctctcaaaggcctgttcctgaaaggaggggcgggaccgtcatccccggagcaacagtctcaccacaaggcactggggttgggaagtggacatgagtggccccattttacatatgaggaaactgtggcccagaggggcagggccgtatttctcacaaacacagagtagaatagaactccctgactcaaaggtacttttttaagtactaatgatggctccaacagagaagatagggaagtggctaaaagatttcacagttcagggtttgcaaactggtagcttcatggccattttggcctacaacatgtattatgtttggacagcagacagtttaataaaaataactttaaagtattaaaatataagtaggccttgctcactccagtttgcccagcctgcccccaactcccaaccctgccaatctatgctaccctttacacatctacagtatctgcttggccttgcaggcacttgaggtttttttgtttgtttggttttgagagggagtcttgctctgtcgcccaggctggaagtgcaacggcgcgatatcggctcactgcaacctccgcttcccgggttcaagtgattctgctgccttggccccgagtagctgggattacaggcgcccaccaccacgccgagctaatttttgtatttttagtagagatggggtttcaccatgttagtcaggctgttctcgaactcctgacctcaggtgatccacctgcctcagactcccaaaagtgctgggattacaggcgtgagccaccacacccagcctggcacttgagtttttgacctcttgtttaggccagctctttattaattattattatttttgaaacggagtctcgctctgtctccgctcactgcaaggctctgcctcctgggttcacgcaattctcctgcctcaacctcatgagtagctgggactagaggcgcccgccaccacacccagctgattttttttttttttttttgtatttttggtagagatggggtttcaccgtgttagccaggatggtctcaatctcctgaccttgtgatccacccgcctcggcctcccaaagtgctgggattacaggtgtgagccactgtgcctggccggccagctctttatttggtagaggtccagagtggccaagccacctgtccagagacacacagccaatctgtggcagggtcagcagcgagctcaggtcagggctggctggctggctctgcctgggacatccacctcacagaggcaccacagttccaagcgacgcctgaagaatcctgtcccttgcagtgtcccaagagcatcttcctgagcatctaatctgatccctgtaacaatcctgggtgctaggcagtggctttatcttccactgagagataaggaaatgagactcagggtagtgaaatcagaccctggacagcagcagtggcaatgaggactatggaaagggaggctggtgaacccaagctccatgttgttgcagagtctggggcaatttttctgatactctaaatgacaatataagctggtgaccaagggtttggagtgaaaaaaaaaaaccaaccaaccaactcagattctggtccctattctgttacttaccagttgggtgatcttgggcaagttacctaacatctctgggcctccctgtcttcttctgtagagataataatagcttctacctagaggatcactgcaatgattgaatgagataatagacgccaggcacacaacagtgcaaggcacataaacattccataaatggtgactctgattatatcctaactctctaatggggatccaagtgcctgggagagaagggatgggttaagagaaaagttctacaccccttgcaaggtgcaagataaagagaatgtggtcagggatgctgacttgtgtgagctcggcctatgcaatctgaaaggctatagggtgacagcttgtcaggaggaggtgttggaaggtcaggtcaaaggctagcctggggtcagaggtgggtgactcacatatttccagcccaaagtggtcttgcagttctcgcagtggatgtcggcgacagcatggaggccggtcagcagcacccgctcctcggctggcccgcagcccacgttcaccctgtggggacatggggtagtcccagggagggtcctgccatcacagggcccaccccctcaagcactgtgtctgtcctcagcatccaagaaatgatgctcacaatttcctgcctgcaccggggaactctgggagtctcagcaggatgccaggggtcacaggtcacaacagaggtcagggaaagcaagaagggaggccagatactcacactgagttgaagaggtaggcacgcccctgactgccctggaaggactaaagggtgagagggtgggaagagaggagggggtcagggctgccggtggggagctgccaggcagcccctataggttccagccccactgtggcctggttggttaccttggagatgaggtcgtcgtggttggccaggtgagcgcggcagtgggcacagctatacctccggtgacaatcatccaagtaggcctgaaacgtcttgggctttgaaatccgcaccatggcgggggccgggggcagtggccccacgcggggagcggcccacggggagcagagggagcccagtgcctgccggggagggagtaggtgggctgtcaggacctgggccacacacatgcgaggcactcccagagccgtggggactcgctctgtcacactgggctgctctctcctttccccagagccagcagcctctccggggaccagaggcgtctcggttttgactcagtgaggaggcctcaggttgcatccatggggaaactgaggctcggaggtgcccagggtgagtcacccgcctgcttccggcctcacccttgctgacctggcagctgaagctggaggaaggggctttggaggggctgggctgtcagttcccagtttcgggggagcatgggcgggtaggcactggttggtccttgcgacctcatctggagagcagtggggttcactggtggtttagggggttcatcggggagagggtcccccacctggaggaggtaggaggcctcgccgtgaaggttgagggtcacctaggaggggaggggctctcacctgcgggcgccaaggcctcctctacgctcaggggctcttacctgcaacgcggagccttacctggactccggggctcacctggggcgcgggggtgggggcgggcgccgggggagggggcagtcctcgcgggctgggcaggggcgcggggcgacacgcagccctgacggcgcgggcctcacctcgcctgggcgcgcggggcccggtccgccggggtgggctggcctgggagtggggggcgctcctggcgggcgccgtcccccccgggcccgggttcgcaggcgcctggacttgtttacaccgagcccagctgctgccgccgctgcggcgggagggggaggggacccgcctcctgtcccggcggccgccgtggccaatgggcgctccgcatgcaaatgagggggcgcgtcacacggcggccggcgcaggccccgaccgcccctcccccgccgcccgctcccgccggcccggaaatgcggctgcggcccgcgcgccccaggcctgctcgcattcctgcttgtggcccgcgcaggggcggggtcggaaggtctaggccgggcgcggagcgaggaagcgggtggcgctgggacgcatgctctgggggagatgagtataatgacccgcgtttgtccgccgcccgtgccccgctcaatccccgcatcaatcccgtgaggccgtttctcccgttggctccactgtaccgggggctgaggcccagggaggtctcgcggctccctaggttatccagctagtaagaggcgaagctggaattctcactgtgggcccattccatggcttttgccagagcgccagggacacactcagttcaccttctagcagggaagacccaaagatgcgcgcccctggcagccagggcgtcggaccaggcaattcctactgtccagcatcacctcctccaggcctctcggatgcctctgttgggacagctaagttcctcttcaaagactcaatttcctggtcataagctgtaaacagattctactcccgctttttcttctttgtcgcacgtctaccctatttgggaaagtttaaaccttagccaatcgggatcagctcagattgtgcggtccaaccccccagccaatggggaaaggacacagaaacaggaactgcgttagggttaaaaaccacttccctcctttgttggcgggtgctcttgggattgcaaccagcgcaagcagcacccttctgcagaagtaaagatgccttgctgggaagtcttctgtctcagtgctggtttttcttgactacactgagcacttgttttcaacaaatttgagggtcttctgggatcccattctcctttgggaggggtagcgattacttttcctcgtgagacacgtcccactgccttgttgcagtggcccaaggagcggaggatcgggtccacccaaagtgaggaataaatccggactttcagcaacgtgggcaggaaggagccttaaaattcccaggcaagtgggtaactctgtgcacagaccaaggtaagaaaagttgctactggggcgacaaagtatttccttggtggttggggtcacttggaggttgaaagtgcatggctgagacatgtcagtggacacgaatcgagtgtggagtccagacttggttccatggtcacctcataaggcttagggcggttttccagtcggggattataccgacccgctaatgctaagaggggcctgaaattcccacgagggaagcggccaaaaagtacgaagcgattattcatatgagtgcaagaaacctccaatgggaaaagggagaggttaagcccctaggaaatgggcaccaacctccagaatgggaaataccccaagtaagacagggagtacaaaaggccaagcagacaataaaattccccctgacagtcctctgggccttatgttagagtactggaggtataatgaaagaaccatgtaacacaaggaaagacagtgaatgataaaatattgctgttttatttggaccaaagaacctatcctcagaccctcagtcttttggccaaagtttggatcagacgaggattggatatgccaactcttaatccagtatgttaataaaaaaagtccagtctctcaagaggaaatagattatgctctgtgttggagacaggaacatgtccttccctttcccttaaaggatgacgtaaaagagaaaccaaactcagtaccctcctaggacaacccagttaagtcagattctacatctaaagatgccaatgtataggatcccctagaccatcttcccccgcctaccccacctcaggctaatcactcagtccctcccccacataaccctgccctgtgggccttgtggccccacatccccattgagcagccacccgaacatgtcctttcctcaggaaaactccagcacgagatggaacaatgccggagggatattcagaactttccttttccctcttcctcaaaggggtctgccccaaccccttttcccttaagtaccactgggaggagggggtattggtttcgtaaatgcccccttaactagttcagaggttagaaatctgaaaaaggaactcaaaccattatcagatgatccttttggagtcacagatcaaattgaacaatttttagggccgcaattgtatacttgggctgaattaatgtccatcttaggtattctcttctcaggggaggaaagaaccatgatccgcagggctgctatgatagtctgggaatgtgaacaccctcttggtcaaaacatccctgcagcagagcagaaattcccagcccaggaccctcagtggaataggaacaatgcagcccactgagaaaacatgaaagacctcagggatatgataattaaagggattcaggaattggtgcctcaaacccaaaatatttctcgagcatttaatgtacaccaagaaaaagatgaagggcccatggaatttttaaagacacttaaggagcaaataagaaaatattcaggcttagacatagaggacccacttggacaagggatgttaaagctctattttatcaccaacagtcggccggacattagaaagaaattacaaaagatagaaaattggcaagactgctccatagaggaacttttaattaagagaggctcaaaggccgggcatggtggctcaagcctgtaatcccagcactttgggaggccgaggtgggtggatcatgaggtcaggagatcgagaccatcctggctaacacggtgaaatcctgtttctactaaaaaaatacaaaaaattagccgggcgtggtggcgggcgcctgtagtgccagctgctcaggaggcttaggcaggaaaatggtgtgaacctggcaggtggagcttgcagtgagctgagatcacgccattgcactccagcctgagagacagagcaagactccgtctcaaaaaaaaaaaaaaaaaagaaagaaagtgattaactctgatttgggttccaccgtcagatttatttattgatttattgatttatttattaaaaaaaaattcccagggaagtggtcaggagaaaacgataccctattcccttagaagctagaatggctctaaaacctataattgagggcctcgtccatgacggaccccttgaaccctgtatgtccccttataacactccaatattgcctgtaagaaagtcagatgggtcataccggctagtagaagacctctgggctgttaatcaaacagctcaaactacccaccctgttgttcccaacccttacactattatcagcaaaatcccatatgatcaccagtggttcacaatgatagatttgaaagatgccagctgggcacggtggctcacacctgtaatcctagcactttgggaggctgaggcgggcagactgcccgaactcaggagtttgcaaccagcctgggcaacacggtgaaaccccgtctctactaaaatacacacacacacacacacacacacacacacacacacacacacgccaggcatggcagcatgtgcctataatcccagctactcaggaggctgaggcaggagagttgcttgaacccaggaggctgaggttgcagttagccgagatcgtgccactgcactccagcctggcaacagagccaggctctgtctcaaaaaataaataaaataaaaaataaaaaaagaaagatggcttttgggcttgccctttagcggaagacagccgggacatgtttgcttttgagtgggaggaccctcacttaggtcgaaaacagcagtaccagtggacagtcctaccccaggggtttacagactccccaaatctattcggtcaaattttagaacaagtcctagaaaacttttcccttccttcatccatatgcctactcgaataggcagatgacctgttcatttcaggaaatagcaaggaccacataaccacagtttcaattaacttcctgaatttcctaagggaacaagggttacgggtctcaaggagtaaaattcagtttgtagaacctgaggtaaaatatctaggacacctaatcagtaaaggcaaacggaaaatagtacctgaacgaattgaaggtgtcacatctctacctttgcctgaaacaaagcaggaacttagaaaattcttgggattagttggatactgtcgtctatggattgactcttatgcctgaaaaacaaaatctctacataaaaaactcacccaagaaggaccagacccccttctttggaccctatcagaagtccaacaagtagaagagttaaaacacctacttgtaactgcccccgttatagctttgccctccttagccattccaccttttcatcagtgtaaacaaggggttggctttaggggtactcacccaaagacacagaggccactggcagcccatagccttcctgtcaaaagttcttgacccagtaacccaccgatggcccgaatgtgcccagtctgtagcagcaactgctttgctaatggaacgaagcaggaaaataacctttgggggaagcctcattgtatgtacccttcatcacgttagaaccattcttaatcagaaggcaggaagatagctcactgactcaaggattttaaaatgtgaggctatcgggtgggtgtggtggctcacgcctgtaattccagcactttgggaggctgaggtgggcagatcacaaggtcaggagtttgagaccagagtgcccagcatggtgaaaccccctctctactaaaaatacaaaaaattagccaggcatggtggcgcacgcctgtaatcccagctacttgggaggctgacgcaggagaattgcttgaaccccggaggcggaggttgcactgagccgagatcagccactgcacttcagcctgggcaacagaacgagactccatcctccacccaccccccaaaaaaattgaggctatcttattagagagggatgatttaacattgaccactggtagttcgctcaactccgatgttttcctaacaggaaatccgaaccgggaggaacctgagcataaatgtttagatctgatcagttatcagactagagtcagactgcatctaagcaagaccctgttccaaactgggcattacctctttatagacggctcctctcgggtaattgaaggaaggaggcataacgggtgctctgtagttgacagggaaaccctcatggaggtagagtcagggagacggcccaataactggttcactcaaacatgtgaactctttgcattaaatcaggccttaaaatctctgcaaaatcaggaaggaactatttacactgactccaagtattttggagtagtccatacctttggaaagatctggactgaacgaggcctcattaatagtaagggccaggaccttgtctataaagaattgattatgcaagtactagaaaatcttcaactgccagaagaaatagtggtggtccacgtcccaggacaccagaaaaacccatcttttgaaaaccggggaaataacctcacagatcaagtagccaagcaagttgcctcttcctgagaggcacccattttccatctgaccccttgccttcccctccagtcgcaatccccatcttctccgacgcggaccaagaaaagttaaaaagaataggagctaaggaaagctcagagggaaggtgggtattaccagacgggagggaaatgctgtctaaacctcttatgagggaaatattatcacagctttatcaagaaactcactggggtccccaagctatgtgtgacacagtcctcaaagcctatgggtatataggaatctctaccctcgctagtcaggtggcggatagttgcctagtgtgcaaaaaaactaataaaacccgaaggaagcagcctttactttatcaagggaaccacccctataattgccaatccaaccagtgcaacccagtacttacctctattactacccctacctccaccgaccctaactccactctaggttgcttctatggcttaggagccgatgttactggaagggaccctataggcttctttgaaatatgttttgttcacccttctccacctcctaccgtctccccctccccaagcccaccaaatcaaaccattcctcacctcttacccaatgacaaaaccaaagtagctatagtagaagtcaaggacttaaagcaaaccctagccattgagaccgggtatcaagatgcaaatgcctggctggaatggattaaatattcttttcgcaccctgaataaaagcgattgttactcttgtgcagcgggcaggccggaaacccagattgtcccctttccactcagatgggccaaccaaccaggcatggactgtatggtagctctcttccagcacaccacagcctggggaaacaagacgtgcgccactctttcactacgtttcccaaagatcaggagccctacgggtcagctcccaaggaccatttgacttccacctctcaatgccagttacaccttgtgtctcccacaacaggacaaattgacgttccttggaaatctaatgggagtctaaaccttttcaagagctaaccaatcagtcagcccttgtctatccccgagcagatgtatggtggtattgtggactgttactgggtacgctgccaagcaattggagcagcacttttgctctaatccagttggccatccctttcaccttggcatttcatcaaccagacaggaagcaagtaacccaaagaaaaagagaagcccctcgtgggcctttgacccccatgtttacatagacagtagcagggtcccacgggagctaccaagtgaatttaaagcttggaatcaaatagccgctgggtttaagtctgttttgttctggtggtctgctataaataaaaatgtagactggataaattatatatactacagcgagcagcgattcgtcagttataccagggatgccatcaaaggaatagctgaacaattaggccccaccagccagatgacctgggaaaatagactagcccttgacatgatattggcaggaaaaggcagagtctgtgtcatgatctgagtccaatgttgtacttttatccctaataatacagccgccgacgggaccatcacaaaagctttacaaggccttaccaccctggcaaatgaattagccgaaaattctggactagataacccttttatgggtctcatggaaaagtggtttggaaaatggaaaggactcctggcttcaatctttacctctcttgcaattgtaacaagtgtacttatccttgtgggctgccgcatcataccttgtattcgtgggttaactcaaaggctcatagaaacagccctcactaaagccttcctctcttctctccctccatacttggacaagctcttgctcctggataatcaagaagaacaacgaagccaaatcctgttaaaattttttgcagaggaagaagtatcaaatagaagagaggaaattgttgggacagctaagctcttcaaagactcaacttcctggtcataaacttctccccgtttttcttctttttcgccagtctaccctgtttgggaaagtttaaaccttagccagtcgggatcagctcagattgtgcagtccatccccagtcaatggggaaaggacacagaaacaggaactgcgttagggttaaaaagcccttctctcctttgtttggggtgctcttgcgattacaagctgcgcaagtagcaccgttctgaagtaaagatgccttgctgggaaatctgtctcagtgctggtttttcttgactacactgagcacttgtttccaacacccctgtgctccaggctgggttaggtctgatctcagggaatgtctgtttcaacacgtgtctgcagttctttggcttgtgttgctcactgcagtgggcccagcctggtctagaggaggcgctcaggaagtatctgtgaaatgtgaatgtgtagttccttcagtgaatatggccctggggctgaagatggcagaagcattctgggagcttctggagaaggagacctgggaggagaaggttggaatggcgggggcagcagaggggctgggtgaactcagctgtcccacccaggcccatcctctgcagcccgagaaggaagctcacagggcaagacatggaagagatcaagttccctgcccggtgcctgggctgttgatggcctcaggaaaatggaaccattacctgttgctgtcaagtggctgggggccaggatgcctgggttggccgtgagaggacattgctgaggagagtggaggccaggctggggtggggtgtggcaggaggacaggaatgcagtggaaccagtgggtcaggctcctgagggccccaggctccagcctcagggctggcctgttccctcctaagctgccatcttcatatcttcaggacccacccctctactcctcaccctcagcacaacgatgtgatcgaaaggcaaatatttatttttcaggaagagaaacaggagacctcgaggcttctggacttaggaggtccgggcagctggtccatggttgtccaggtagtgccgcagggctgtgggataatccgttatgacgccagtggctcccacgctgaaggctgcttcaaaatccgactcttcattaaggcaccaaaagaccacctgagcagggagggagggggcctgtagattctgaacaattttacatctggagagtggggacccacctcctcctctatggagactccccagcagcagtaggctggagctgattgttaaattctcaggaattttgcaaagtggttattaaacccagccattattaaaaattaaatcatagcctgggtgcagtggctcacgcctgtaatatcaacactttgggacgccgaggcaggagttgaggccaggtgtttaagatcgagtgagacctcatctctacaaaaaactttgtaaaaattaattagcccggtgtggtggtatgcgcctgtgctcccagctacttggaagactgaggtgaaagaattgcttgagcccaggactctaaggctgcagtgagctatggttgcaccactgtactccagcctgggcgatacaacaagacctcgtctcaaaaaaaaaaaaaaaattatatatactgacaattaaattatttatttatttatttatttattttttgagatggagtcttggtttgtcacccgggctggagtacagtggcatgaactcggctcactgcaagctctgcctcccgggttcacaccattctcctgtctcagcctcctgagtagctgggactacagatgtccgccaccacgcccagctaatttttctgtttttagtagagatggggtttcaccatgttagccaggatggtctcgatctcctaacctcgtgatccacccgcctcggcctcccaaagtgctgggattacaggtgtgagccaccgcgcccggccctaaataaattattaaaacaacaagtggccaggcgtagtggctcacgcctgtaatcccagcactttgggaggccgaggcaggcagatcaactaaggtcaggagttcgagaccagcctggccaacatggtgaaatcccatctctactaaaaacagaaaaattagctgggcgtggtggcgggcgactgtaatcccagctactcagaaggctgaggcaggagaatcgcttgaacccaggaggtggaggttgcagtgagctgagatcacgccattgcactctagcctgggcaacagagcaagactctgtctcaaaaaacaaaacaaaacaaaaaacaaaacccaaaacaaacaaaaatccagtaataaatattcaaagcatatctcttgctaatcagtttcctattactgtgttcttgaagtgattaagtctgttgaggctgcaagatggaaatactacatgatggggtgccaccatgcatctcttcccattctgcatttagtggcttcatgtcggcagcctgaaactggccaagatgggagtatttaaaccaggaaaattaatcctcaaatcagggctttcatttgttcctctctgagagctagttgttgaccacttaacagcaccaccctcccccaaacccccattccactgccacctgccccagctcctgcagctctgccccttccctgcccgttgagtgggcactgaggtaggcggagatgggaattttttatttaaaaatacagatgagacgaggtctctctgtattgccaacactggagtgcagtggtgtaatcacagcccactgtagccttgacctcctgggctcaagtgatcctcccacctcagcctcctaactagctgggactacaggcatgcactaccatgcccagttaatattttatttatttatttatttatttttgagacagtcttgctctgtcgcccaggctggagtgcagtggcgtgatctcggctcactatagcctccagctcctgggttcaagtgattctcgtgcttgagcctcccaagtagagctgggattacaggcatgcgccaccatacccggataatgtttacatttttagtagagatggggtttcacaatgttggccaggctggtctcgaactcctgaccttagttgatccgctggccttggcctcccaaagtgctgggattgcaggcatgagccactgcaccctgcctctgcatttttcttttctttcccttttcctttcctttttcctgtttccctccctctcctccctctccctgtctctggctctcacgctctttcctctctctcttttgagacagtctggctatctctcccaggctggagtgtggagtgcagtggcgtgattctgattatagctcactgcaccctcgaaaccccgtgctcaggtgatcctcccatctcagcctcctgagtggctgggactacaggtgtaaaccactgcgcttggctaatttttaaattttttgtagagacgagggtctcagtatgttgcccaggctggtcttaaactcctgggctcaagtgatcctcccaccttggcctctcaaagggctgggattacaggtgggagccgtgcccagcctctgcctatggcatttcttccctgtacccttgatgggaagctcccacccctagtaccatagtgcctggaacattctcaaggatcgtttactaattaaatgatctggtggaagccaatgctcaggggagaggggggtgggctgggcctggtttctcccatctctcatctttccccagccccctctcatcagggatcatgatacatcattgttgtcatcataatggctaacatttatcaagcccttaataagtactagttacatatccatatgttggcaatgtcaggttaagaaaatatgtgcgtggccaggcgtggtggctcacacctgtaatcccagcactttgggaggctgaggcaggtggatcacttgaggccaggagttcgagaccagcctggccaacatggtgcaaccccgtctctactaaaaacacaaaaattagccaagcatggtggcaggcacctgtagtcccagctactggggaggctgaagcaggagaatcgcttgaacccgggaggtggaggttgcagtgagccgagattgcaccactgcactccagcctgggtgacagagtgagactcttgacacacacacacacacacacacacacacacagaagaagaaaattgtgtgtgttcgtgtgtgtgtgtgtgtgtatccagagagttaaatataccattttcccattttagggacgaagaaactgaggtgaggtcacctgcccgagtgatgcagctagttggcagcagagtgggaccggaaccctgctgccaggtctgtgtgcggtggaagtggtggtcacggcctcacctgcacccctcgctcctccaagtgtcggatcagactcttcctcatgatcagcctgggggtggggtggggacgtgggaggtgatgatgagaggggacctgggagaagggcagcagtaggtctctatggggacacgccacccagccatcttgcccacctcaccatttcgaaaccacagccaataactggttcaggcaagagcaggaaaatgggaaataggtcctgcagagagaaggaagtgggggttagctcctagggtctcccctgtcccagaggtggggtgggctggtagtgcccccgccaactagggtagcgctgccctcccaccccccagaatcccccagaataacctttgtagttgccccagtgaacaattcacccattgttcagagagcctactctgaccaccacgcttcaagggtgtggccctccagtcaccattcaccagataaggaatctgggccttagagaacgaaagggacttgccagacccaaagcagagtggtggtggggctgggccagggcctcgcttggttccaaagctggacatccaggctgcaggccctcctggttgggcctggccagcttcttatttatctatttatcttattattaatttaaattaatttttttttttttgagacagagtcttgctctgtcgcccaggctggagtgccgtggtgcgatcacagctcactgcaagctccgcctcctgggttcacaccattctcctgcctcagcctcttgagtagctgggactacaggtgcccgccaccacgcctgctaattttttgtatttttagtagagacagggtttcaccctgttagccaggatggtctcgatctcctgactttgtgatccgcccgccttggcctcccaaagtgctgggattacaggcgtgagccaccgtgcccggccattaaaaaatttttgtagagacatgtctcactatgttgcccaggctggtcttgaactcctggactcaagcaatcctcccgcttcagcctcccaaaagtgccaggataataagcacgagccagccaagtgtggtggctcacacctgtaatcgcagcactttgaaagtctgaggtgggaggagaccagcgtggccaacatggcgaaacgccgtctctactaaaaatacaaaaattagccgggcgtggtggcagaccctgtagtcccagccacttgggaggctgaggcaggagaattgcttgaacccaggaggcggaggtttcagtgagccaagatcgcactactgcactccagcctgggccacagagtgagactccttctcaaaaacaaaaaacaatggccgggcgcggtggttcacgcctgtaatcccaacactttgggaggccgaggcgggtggatcacctgaggtccggagttcaagaccaccctgaccaacatggagaaaccctgtgtctactaaaaatacaaaattagccaggatggtggtgcatgcctgtaatgccagctacttgggaggctgaagcaggagaatcgcttgaatctgggaggcggaggttgcggtgagccaagatggcaccattgcactccagcctgggcaaaaagagcaaaactccgtctcaaaaacaaacaaacaaacaaaaaacccacaaaaaacctcgtgagccactgtgcccattggccagcttcttgagaccagacagcacttagtgggacgacccctaattatcccactccaggggtgactttagagacccttgacagtgtcctagggcaggctctggagtcagacccagggaaaacctaagctctggatttccagctgtgtgtccttgggcaaattacagaacctctctgggcctcagattctctagggtaccatgggagtcatgattcttatacctcctgggggtgctgcaaggtaaaagtcaacccaaaatatgttaaaacactttataaatcttgtataaggccgggcgcagtgggtcacgcctgtaatcccagcactttgggaggccgaggcaggcggatcatgaggtcagattaccatcctggctaatacggtgaaaccccatctctactaaaaacacaaaaaaattagccgggtgtggtggcgggcgcctgtagtcccagctactcgggaggctgaagcaggagaatggcgtgaaccagggaggcagagcttgcagtgagccgagatcacgccactgcactgcagcctgggcaacaggggaagactcctcaaaaaacacaaaaaaaatccggtataaaaaggtggtacacaaatatcattgatctctttgtagcaaggtattgtgggggctgagtgggacttccttctggacaacagaggggagcagagagctctgggactaccacagagaagctgtcagaaagcaaagggagaccgggcccaggggctcaggtatgtaatcccagcactttgggagaccaaggtgggaggctcgcttgagctgaggagttcaagagcagcctggtcaacatagtgagaccttgtctctacaaataatttaacaattagccaggtgcagtgttgcacgcctatactcccagctacttaggaggctgaggcaggaggatctcctgagcccaggaggtcgaggcgcagtgagtcatgatctggccactgcattccagcccgagcaagactgtctcaaaaaaaaaaaaaaaattgtaaagcaaagggagggactaggcttaagtgccagcgaagtatccaaattcctgatcctttccccagctgttactttgttaacccctgccttcctgcagaacactgacttggccttttcctgctgagggtctgagacagccgtgctataattaatgaacgaatgtctccccagccagactgtaagctcaccaaggacctctccccaccctcactggtctcatttacacattataactgcacctgggacagagtagacattcaataaaatatgctagatggcctgagatggataaattacctctctatcctaaaactccacatatgcacagaatttcagggtgttcacagttcccttagtattcatgaatgctgggtaagaaccactgtccttaaaagaccttgggggttatctctgaggggagctggggagctgggaagatctgggctccttctccacggagaccctaagcagtggggagtttttctgaggtccgccccccactggtacctgttgatgatgttgggcaggaagcagaagaagaacttctcagggattgggatgaagggcagcagccccaggtagtaggaaagcagcacccagaatcctcggcttattgtgaaggacaggggcatctcggggttctggggaggcaaggagaggcatgagaatctgtctgctctggggaagcagagaggaggcatgagctgcaggggagccgtggtgggcattccagaggccctactacctgcaggatccaagtcacatcttggggctgggtgtggtggctcacgcctgtaacctcagcagtttgggaggctgaggcaggtggatcacctgagatcaggagttcaagaccagcctggctaacatggtaaaaccccatctctactaaaaatacaaaaattagctgggcgtggtggcgtgcacctgtaatcccagctactcgggaggctgaagcatgagaatcgcttgaacccaggaggcagaggttgcagtgagccgaggtcgcaccaccgcactccagcctgggcgacagagagagactgtgtttcaaaaaagaaaaaaaacaaaagtcacatcttggctctgtgttcgaggcctgagttcacacccttttcattgccaccgccacgccactgggaactctcccagacccctctagctcgggtccccatgctgggtgggctccagctctggggaggaggggcccctggaggaggaagaggacgggggaggggtggggggactcacggcagccttgcatttcttcatgaccgagctcttctccgaggcccagatggtgatttcattacggtcatagcgtctcaccaagcctgctatctgggaggaggagaaggaggtgaagggagagccaggcctctctcacgcccccggtggccgccctagccctgcctgcagcaccacctcacggatgagctcttcgttcttccctttgatctctacgctcatgggtgtccttggaaacctctggaacaggtcctccagacgaaccatgcgccggtctgacccgtgagcaaagtggcctgggggtggtgtgggaaaaggggtcagagggaagccaaggcggaggtccaaggaaggcaggcatggcccaggcagggctcgaagcccttgctctcacctggagagaagtaaacctccagcttctccttgtagaggggcaggtcctggggaggacaggaaggatgtcactagaggcccgcattgggcatggtgactctcagggtgggggttggggtgtcagggcagggcccacctcgaagtccaggctgcccacatccctgtttaggcccgactggcggcacaggttctcatcatgtgacaccaccaccactctgtcccgtgtcagctgacagtcgagctccaggaggtccgagcgctgggccatggagctgtgggggtgaaggtcagcggggggcaggggcaggggactgggatgaggggcatggtggctgggaggtggccgggaatgtgagagcggagttcgtggcgggatgtgcaggccacctccagggggcgccagtcacccagctaggaagtgaatggcgtcccttgctgtgatgcagtccacgacctgcacaccctcacatggcagcctgggcaggggcagatacactcacttctccatggcctccatggtgttctccagcagctctccagatcctgtggggggcactggagtgggcctctggggcttggggtctaggggcctggcccaacctcatcacccacattccctctctgggctccatcctccctctggcctcacctccccagccagcccaggctgcgccagcatcttcttcctcgtccacaccctgccctgccacttcgctctccttctctcttggtccctgccccgtttctagcatgcccccttggacctacccctctgtgctgtccactttggcacctgttctcacccctacccggctcacctcctcggtgggcccccaggcggatgcggaaggtgggagccctgggcgtgtgcagcagatgaggccggcgcaggaagaagatggagagcatggcatagctgcccagggcagggagggcatagtacagcaaaaggctcatgaccgtactcccacagaagctcctgcagccacacgctcagccgtccgcgggactgtgctgcctgcctagccagtgtgggccggctctactactggccactgccacgcccctgggacctgctgagcctgccgctgggctggcttggagccaggctgcagggttcggctgaagctggggtagtgtcaggaggtgaggcaagtagccctggctctcatatccccaggcccttcccagcccccagcagccccgtcctgggctacatgaggggagtaaaaaccacccaggactgtcaggacctctccctctcactggtacttgtagccagcgcatccaacatgcctaccccttgccatttcagaggatccaggggtgtgtagggtgctcctgagtcaccccgaatcacccccagccagttagacaggaagccattagcgagaggacaggacagtgactaaggggaaaactgacccccttctttctaggagtctggagctctccagagccccgtccccagccctgggcagctgggagtgaagggcaccaggcccctgaaagcccaagtcaagtctgtcctcagagccgcacggggcagggcgggggcgtcgcgaacacagacagagccagggtcagccatagacacatctctatatttatatattagacgggtcagggaggtggcaggggcgccgggctctccacgccccccagctccacttctgctcaccacacacagaagcagcgagggcacgcgaagtgacagctttgacagggaggggattcggcccggcctggctcctcagggatgctagcccttgagactaaggaatgttccttcagggaaactagggtggggtttgaatgagatgaggggggcaggcatggccctgagtccctactcagcgccccccaccctccacctctgcccttcagcaggttggggcagccagaacccttccattccagaactgccagagactgggacgctggggaaggtaagggcgcagcagcagcagcgggagattgaactggggccacctgaggtcccgaggccccgtggggagggcgggtggggaggagaaggccttggcctgcctgaagctggaggcctcagcaaaggagagaggtggccaggcccatgctccaccccggcctgggctgccaaggtccgggctgggcacagtgtccattttctaacagtctggcgggagaggggcaggcaggaggcaggtcctaaagagagaagcaggcagaagaggagtcgttagcaccccccgggcagacccactggagccctgacctcaacatctctcatttcaccctcacagctggataggctgggtctcagtttccttatctgtaaatggagataataatagtacctagcttgaggtactgctgtaagattaaaggaattaatacatgtaaacctcttagaacaatgcttagggctttatgctttcattattagaactgtctcggccgggcacagtggctcacgcctataatcccagcactttgagaagctgaggtggtggatcgcttgagcccaggagtttgagactggcctgggcaacatagcaagaccccagctccacaaaaaaaaaaaaaaaaaattagccggttgcaatggctcgtccagctagctgggaggatcccttgcacccaggagttttgaggctgcagtgagctatgattgcaccactgcattccagcctgggtgacagagcgagacactgtctcaaaaaaacaaaaccaaaaaaaaagataaatagattgactccggaaactgaggcgccgagaggtgaggtgccttgcccaatatcacacagcacttactaagtggcacagctggagtttgagcccaggtgcgcatgccttctttctatcaggccacacctggctgaagacaggaagagaccggaggaggcaaggaggcagcgtgggtgggggcaggccagtggggtccccacagctatgtgaactgctgatctggcagcaggtgtgaggaggcctggcaatctgggtcaggctgggcgctgctgggcccctcccaaagcaatcatggccccacctgcttctgccacacccagagctgaagcttggctcaggtcctcacctgggtgacagaggccctcagtgacctcttgcctctttgccagttctgttcctagaaggagattagaatggcttgtggggctggaggatgcaaggtgttgacaggcagagacatttggggctggaggactcggtgggccaccagtctgggcagccttgggcatttttttttttttttttgagatggagtcttgctctgtagtccaggctggagtgcagtggtgcgatctcggctcactgcaacctctgcctcctgggttcaagcaattctcctgcctcagcctcctgagtagctgggattataggcatgtgccaccacacccagctcatttttgtattctttacagtagagaccgggtttcaccatgttggccaggctggtctcaactcttgaccttgtgatccacccacctcggcctcccaaagtgctgggattacaggcatgagccactgtgcccagcccttttttttttttttttgagagagtctcactgttgcccaggctggagtacagtggtgcaacctccgcctcccaggttcaagcagtcctcccaccacagcctcctgagtagctgggactagaagcgcatgcctacgtgcccggctaatttttgtatttttagtagagacagggtttcaccacgttggccaggcaggctggtctcggactcctgacctcaggtgatccacttgcctcagcctcccaaagtgctgggattaccagagtgacccactgtgcccggctaatttttgtatttttagtatagatgggatttcaccatgcaggccaggctggtctcaaactcctgaccctcaggtgatccactcctctcagtctcagtctcccaaagtgctgggattccaggcatgagccaccacacccagccccctgggcacttctgttgtcaccagacacattgaccatgggtgtggggtaagcttgctgctgtatggaggcatgtacagatagatatagatatagatatacagatatagatatttagtatcagggtgtccatgtgtgggccatggagacactcaccaggccccagggtgcagagatgtctgtctgggctagggggcctccagcactccgggctggaagcgtgctgtctcctggaagatgagctccttcagccgctccttaggtaggtcatccagctccatggcgaaggtgaagggctcctcggccactggctggggtggtagagacagcaaggctcaggcctggcatgggggatgcctacgtgcccccctgctcccctgcccccagccccactgctgctggggactggcccacctcatccgtcgggtcatagtactgctccaggtaggggtgagccagcgcttcctccactgtgatccgtttattggggttaaaggttaacatccggtccagcaggtcaagggctatggaagggcaggagtcaggggtcacagggaagactggaggagctccgagaagcattgctttgcctgtctcctccagcggctgctgggctcacacaccctccacgacacccaaggtttatcccacacccaccctcatgtctctcgaacctttggagtctgacttggggaaaagcttggcccaagccaccttggtcttggagggcagagactgtaggtagtttcgggccttcatgttgatgatacaattcaggtcctcctgggatggggagcccaggatgcctgtggataaggaggtgacttggtaaatgatcacctctttctttctgggaacagaataggcaacaaggcaagaacaagaccccccagcccagcaacccatgccaatccctcagtcacctcctagtcattagcatggtggtgcagagcaagggggctgggttcaggcagaccgaggctcaaatcctaggtctggtgcctcctcaggtgtgggacttagccttgcttttcccatctatccaatggggataatatctatacctcattgagataccatgagatgctggaggcaccccacacgtggtggtatccctgacttggactctcgagaaatctcacctcggaaaagctaatcatccccaactcagccagccgggcctccctcacccagaatgtggttgagctgatccaggtagtgcttgccagggaagatgggccggttagagagcatctcagccagaatgcagcccacagaccagatgtcgatggacttggtatagccctgggggagaggaggaagtggtgagctcctgggccagcctcaacagggtcctgttgtctgcgccaggccaccacctccaagttagatccaacaccaggcagaaggcagaggcctggagggctcaatgctcagcttccttgcagagcccaaggcccagagggtagaattcctgtgtcatgggggtcagtgtctggctcagaggtagctccagggcttcctgggaactggtccgttcctttcaggagtgggcagcccctcctaccttggagttcagcatgatctctggggcccggtaccagcgcgtagccacatactccgtcaggaagccggtgtggtcatgctcaggatcggcaatccgggccaggccgaaatcacaaatctggaatcagacctagctgctaagctcggcgctcaaggcctctgcagcctaagcagtcacgcccccttgtctttgcctccactgttccctttgcttgcaatgttctcctgcccaaggcttcttctactggtcactggaagccccagaccctgggggaggaggggacaggtgcccaaccctctgaccttaaggtcgcaggtggtgttgatgagcaggttggagggctttagatctcggtggagcacgttggcggagtggatgtacttgaggccccgcaggatctggtagaggaagtagcagatatggtcattgctcagctgctggcttttcagcaacttgtacaggtcagtctccatcaggtcctgcacaatgtagctgaggatggttccgcagacccccccaggcagggggcagtgggaggcacttggttaaggaaaacaggctctgaaggcgaggctgcacacctcctccagccagggcccctgggactcaatagatctgccaacctgcaccaccagctggggaagctgctgccattacccagcggcagggctctgagcctctgttgcatcacagttgctgatcctgagcaaggggcttcatttctgaggcctcagtttccctaccggggaaacggggataataataaactgtgggaggcaggagaacttcacagttaagagcagcaacttgggccaggagtggtggctcacacctgtaatcccagcactttgggaggctgaggcgggaggactgcttgaggccaggagtttgagaccaccagcctgggcaacatggcaaaaccctgtctctactaaaaatagcaaaattaactgggcacggcggcatgtgcctgtaatcccagctactcaggaggctgcagcacgagaatcacttgaacccaggaggcagatgttgcagtgagccaagattgtgtcactgcactgcagcccggatgacagagtgagactctgtctcaaaaataaataaattaaaaaaaaaaaaaaacctacaaaaagagcagcaactctggagttaacccatggatgtctgaaatctcctctctactactcactggctttaggatctcaacctgtctgtgcctcaactttctcatctggtatgtaggggaaataatgtttttttgtttgtttgtttgttttctttttgtggagatgggctcttgctctgttgcccaggcaggtcttgaactcatgggttcaagtgttccttccacctcggcctcccaaagtgctggaaattacaggtgcaagccatgaaataatggttcttttgagggtggttgtgaagactagatgagatggcgcatgtaaagctgtcagcccagtgcttggcaagttgtgagtgctaggcaaacatgaactattattactaatatgaatgcctgagtcacatggctgttgagggagttaaatgagataatgtatgaacaccatctggcatgcaataaatgtttgcttaaaaataaatgcctgccttatgggaatggtttgtgcaagaaaaatgaggagacactcccaacagcacactcccactcaaaggagagtgcttggccatacctcagaagatggaggagtaaaatgtctttttctatttgaagatacaaaaaagcttatgcgtaaataaataaataaatccacaaatgctgtttggcttgtctctagaaaaataagtcagggctgtcttttagaatctgccttgagaccaggcatggtggctcatgcctgtaatcccagctcttcaggaggccaaggtgggttgatgacctgaggtcaggagtttgacgccagcctggtgaacagggcgaaaccccgcatctactgaaaatacaaaaattagccgggcgtggtggcaggcgcctgtagtcccagctacttggaaggctgaggcaggagaatagcttgaacctgggaggtggaggttgccgtgagctgagattgagccactgcactctagcctgggcaacagagggagactccatctaaaaacaaacaaacaaaaaacaaagaaaacaagaatcagccttgaaagggtcttcagagaatatgtggaccagccctgctgttttagggctggggaggcccagcgagacgcagtgacttgcttcagatcacacagcgagctgggggtgagcacggagatttcctgtccacagtttgtggtgggggttgcagacacctcagtacaaatccccactcttgggtggagggctgggactgagagtgggtgggtggggcagggaagaagtgacaggtgtcataagttgctaaggagagccagacaggaagtggacagcaaactaggaaagcagtattgggggaggacagccaaggctaggctgtccctccctgggcaaggtgcaagtccacaggtgattagggtgtggctctgagtgagaagtcctaagaagaaggacaagttcccatctgggggaggagaggaggagacagcaacagaaacacttgattttaggttttctgagccttagcttcctcatctttttttttttttttttttttgacagggtcacgctctgtcccccaggctagagtgcagtagcacaatcatagctcactgcagcctcgaactcctaagctcaagccatcctcctgcctcagcctcccaagtagctgggactatagtcgtgtaccaccaaacctggataatttttaaattttttgtagaggtggggtctcactatgctgcccaggctggtcttgaactcctggcctccagtgatcctctggtcttagcctcccaaagtgttgggactacagatgtgagccattgcactccacccctcatctttgaaatgaagctgaaaagcccatctcatagggtagttgggaggtgtaatagaaaaaaaaaagcattgggcatgtatagtacctgacacacagcaggccctcaagaaaggcagttttttgtttttgtttagttttgagacagagtctcgctctgtcacccaggctggagtgcagtggcacgatcttggctcactgcaacctccagctcctgggttcaagcgattctcctacctctgcctcccaagtagctgggattacaggcttgcaccaccatgccccgctaatttttttgtatttttagtagagatggggtttaaccatgttggccaggctggtctccaactactgacctcaggtaatctcccacctcagcctcccaaagtgctgggattacaggcgtgagccaccacgcccagctgacagttttctttctccctgtctcccttccggtctgggcaaggaggaaagagaggaaagaatcatccattccttagcaagaagtgactgtgggcagaggccaggtcatgtctcagaactgccgacgtcagaagacaccactcccatagagaccatcctgcctagcccttccccctggggcacagagcagagaacccacttgctcgaggccatactgcctgggccgctgcaggcctgggttcatcagaggtctccaagtcctgttacactgtggcttcccctctgcaggaaagtttattttactgggtttgttttggagggtggtgggtaagatggaaacagaaaccaagcaacgggtccccagcccagctgcgaggccgtgcctgaccagccgactggccaaggtgaaggatacacatctctcatggcttccagggtggacgcccgcagaatgtctcggatgccgatgacattctcatggcggaagcgcagcaggatctggatctcccggagcgtgcgctggcagtaggtctgatgttcgaaggggctgatcttcttgatggccacgcgagtcttgcgcacgtggtcataggccgagctgaggggaccggagagaggctgctgctgtggccttacaaagggggagtccgggcctggtggccccacccaggccttggcagggaggggagagagcaggagctggctctggtcaaatcataaacaatgctggttccttcctgctgtggaggcctgggatctccagagagaaagctggggaccagccaggcggcccttcggtgactttacaaacagaggaagagactgaccgctcactgacttcccctctcctcaatccccttccattctactggccctgaacccttcgcccccattcccaggaaaggctccttaacccaagacaggtccgggggtgcagatgctggggacacaccatggggcaaatactgggaaggtggcagccaggggaggggcaggagagaatggacagggcaggggagggtcccagggtgagggatccgggcagcggggctgtcccagagggatagaggcccagagcacacggtggggccgggggcactcacagacccctcccaaaacatgcaggtggcactcctggccgcctcatctctctctgggcccctggggtggtggggccaaagccctgccccaccctgatctcggctcttctcccccaggctccctggcactgcctcacagggggaatccaagacaccctttcccccaaaacgggccctccactgcctcttcactaaggatgtcgcctccccgagagtactcatcctctgggcctcgccccgtgtcactagggtccccgcgggcccccacatgcactcggatgcccctcccatcattacagaagggtggactcaaagcctccaagcctgctcccctgaggacgtaggcagcgccccctcccccagaaagcactcaggggccccctccctgggacgctcccgatcatcccgagtctcctgcctcctcgggacgctccgcgtctccacgtcccggaaagcgctcggcgcctcctcctcctctcccgcgaagccccctcccctgagggcaccccctcccccggaacgccccctcacctgaccatgccgtacgcgccctcgccgatgtactgcaactgcgtgtagcgcgggcccacgtcgaacggctgccccttcaccatctccacctcccccgggacccccgggccgaccccctcggttctacggggctccccgcccccgcccccctgagccgccgccgccgccatctccactcctcccctcccaccgccctcctccccacggcggccccgcccgaggccccgccccttcccgcctgcctgtcacccgcagggccgcgcgcgccaggccccgcccttgccccggccccgcgtgggcctggagctgtcacgtgacccgccccgcgcgcgcccgcccttcttgccccaggttcgggggccatgggtccctgcgggctccgcggcctccaggtcaccgggaggttcggcagcgccgcctcggagactgtcctcaccctcccctcgatggcgaagcggccagggcgtgacctaccagagccacccagccaatgtatgcggcagcccaccagaacctgggcccgggatcaccctaggttaaaaataatgttctaataaatggatcaaattttacagatggagaatctgagagttaggtttactaacttgggtaaggtcactagtagtgacagctgagactcaaaatggtgtcttctgacacagagactctttctaattccatgcctctcagagtcctagactgtttttattttattatagagacagggtctctctctgtcgtccaggctggagtgtagtggtgcaataattgctcactgcagcctcaacctccctggggtcaagtgatcctcccacctcagcctcccaaagagctgggactacgagtgcgcgccaccacgccctgctaattaaaaaaaaaaattggggggctgggcacggtggctcacgcctgtaatcccagcactttgggaggccgaggtgggcagatcacctgagtttgagaccagcctgaccaacatggtgaaaccccgtctctactaaaaatacaaaaattagctgggcatggtggcacgtgcctgtaatccaagctacttgggagactgaggcaggagaatcgcttgaacccgagaggaggaggttgcagtgagctgagattgcaccacttcactccagcctgggcgacagagcaacactccgtctcaaaaacaaaaaacaaaaagaagaagagaaaaagtagggttgcagaaggtagggactgaagaaaggcatgaaggagaaggatcggggtgagctgaggcataaaggcagaagcataacttgtccagcatggctgcagtaaaaaaatgatgaggtttcagcctggagaggtaggttggggccagattaggaaggctctggattctggcaaggagtttggatgttactcagtaagcagtaaaaaccctagagggacttttgccagatcattttgcaactgcgggagaatatagtgactcagagaaaacactatggagttcagcatggagccaggtttgctgagtgggagtgagtttcccagcataggaaaggctggtgtatcagagctgcaagctgccacctcctgctgctggaagctcagttagagtgtgactgagattcccctctagtgactgaggttggcatttccttggaggactggactgggatttgttctggttcatagacgcatattcaactaatgtagacttaccatctcttctgtgccaggcacttttggtttttttttgtttgtttgtttgtttgtttttttgagacggagtcttgctctatcacccaggcaggagtgcaagctcactgcaacccctacctcctgggttcaagtcattctcccacctcagcctcccaagtagctaggattacaggcgccagccaccacgcccggctaatttttgtatttttagtagagacgaggtttcaccatgttggccaggctggtctcaaactcttgacctcaggtgatccacccacattggcctcccagagtgctgagattacggcacctggcttgccaggcacttttatgtacactacctcctgtaatcctcacagcagccatatgaagtagatactattaacatttaactggaaaatgatgctggctggtcgtggtggctcacctctgtgattccagcactttgggaggctgaggcaggctgattgcttgaccccagcagctggagaccagcctgggcaacatagtgagatcccatctctaccaaaaatacaaaaatgagctgggtgtggtggcatgcgtccgtaatcccagctacttgggaggctgaggcaggaggatcagttgagcccaggatgttgaggttgcagtgagctctgatggtgccactgcactccagcctgggtgacagagtgagagaccctgcccccacccccacccccccaaaaaaagggacagagggaaaacgatgtggaagcttacgctctgtcacccaggctggagtgcagtggcgcgatctcagctcactgcaagctccgcctcccaggttcacgccattctcctgcctcagcctcctgagtagctgggactgcagacacccgccaccatgcctggctaattttttgtatttttagtagagacggggtttcaccgtgttagccaggatggtctccatctcctgacctcatgatccacctgcctcggcctcccaaagtgctaggagtacaggcgtgagccactgtgcccggcagaattatttttctagcacagggtcttgctctgttgcccaggctggagtggagtgtagtggcaagatcataggtcactgcaggctcgaactcttaggctcaacagatcctgccaccatgcctagcacacacaaccacgcctagctaattttttttttttgtttttgaaacggagtcttgctctgttgcccaggctggagtgcaatggtgcaatctcagttcactgcaacctctgcctcccgggtctcctgcctcagcctcctgagtaggtggaactacatgcgtgtgccaccatgcctggctaattttttgtatttttattagagagggggtttcaccgtgttagccaggatggtctctatctcccgacctcgtgatccgcccgtgtcggcctcccaaagtgctgagattacaggtgtgagccactgcgcccagcatttttttttttttttttgagatggagtctccctctgtgcccaggctggaatgcaatggcacaatctcggctcaccttgacctctacttcccaggtcaagcgattctcctgcctcagccttacaagtagctgggattaccggcacacgtcaccacgcctggctaatttttatatatttagtaaagatggggtttcaccatgttggccacgcaggtttcaaactcctgacctcaagtgatctgcccactttggcctcccaaagtgctgggattacaggtgtgagccaccgtgcctggcttggctaatttttagaatgtttgtagagaagggttctagctaatgttgcccagtctggtctcaaatttctaggctcaagtgatcctctcacctcggcctttcggagtgctaggattacagtcatgagccacttcggctggctccagattaaatcttaaaccagttattagctttttgtgattttcaaggtctggcacttctttttttctttctttctttctttttttttttttttgaggcagtgtcatgctgtgtcgcccaggctggactgcagtggtgcggtcatggctcactgcaacctctgcctctcaggctcaaatgatcctctcacctcaaccttctgagtagctgggaccacaagcatgtgtcaccatgcccagctaattttagtatttttggtagagatggggtttcaccgtgttgcccaggctggtctcaaatgatccgcccaccttggcctcccaaagtgctgggattacaggcatgagccaccatgcctggcctgaaatagttatttattcttcttattattagtagtagtattctggtctttcatgaccgtagacttttgaagattataggtcagttattttgtagaatgtccctcagtttgggtttgtctgatatttccttgtgattctcatgtcactttgcctttactattgtattgtatcgagacgaggttcaccatgttacccaggctagtcttgaactcctggtctcaagagatctgcccaccttggcctcccatcatgctgggattacaggtacaggtgtgagccactgcgcctggcctttcttttcatttcatttctttccttttttttgagacagggtctcgctctgttgcccaggctagagtgcagtggcatgatcacagctcactgcagtctcaacctcccaggctcaaatgatctcccttcctcagcctcccaagtagctggcactacaggtacacaataccacatctggctaattctttttgtatttttattaggatgggtttcaccatgttggccaggctggtctcaaactcctgacctcaagtgatccacctgccttggcctcccaaagtgctaggattacaggtgacagccactgcgcctggcctaattttttaaattttttgtagacacgacagtctggctatactgcccaggctggttcttttttttccccctgagtcagagtcttgccctgtcacccaggctggagagcagtggctcgatctcaactcactgcaacctccacctcctgggttcaagcaattctcctgcctcagcctctcgagtagctgggattacaggtgcccgccaccacgcctggctaatttttgtatttttagtagagatggggtttcaccatgttggccaggctggtcttgaactcctgacctcgtgatctgcccgcctcggcctcccaaagtgctgggattacaggcatgagccactgcgcccggccccaggctggtcttaactaggttcctttctgtctgtctccttcctcctcagatatgcctaaaacatggccctgatgaggttgtagtaggcaggaatctttcagtaacaagtcttcaaagacccaactcaaaaggactcaagcaagaaaggaggtgcattggcttactgactgtgaagacacagttggctccactgactcaaacagtatcattaggactttgatccctcccttagctcaactttcttctgagttggttccattcttagccaccccctcctctcagagtagccagatggaagctagtacttgcagattcgtgtctggttttttcagtaactccagcaagggaaagctcttctctctctgtctctctttctccctgtctctgtctcttgtaatgcaaggcctagatttgactcttattggttactagtttttttgagacagagtctccctctgtcacccaggctggagtgcaatggtgcgatcttggttcactgcaacctccaccttctgggttcgagagattttcctgtttcagcctcccgagtagctgggattacaggcgcccgccaccacgcccggctaatttttgtatttttagtagagacggggtttggccatgtgggccatgctggtctcaaattcctggcctcaagcgatccactcacctcagcctctgaaagtgctttgataacaggcatgagccaccgtgcctggccagttactagttttgtttgaagcctgtgcaaatccttcaacctgaatcagtgtggaattgggggtttagttatctctactggcatgacataaagtaggctagggaagggatggttttcccaaggaaaattcgggcaccatccccagaaagtgctgagcagacagttacagcagtgtctattataatatatatatttttaattcctccccccacctttttttttttgaggcaaggtctcgctctgtcccccaggctggagtgcagtggcaccatcatggctcactgtagactcgaccacccaggctcaggcagttctctagcttcagcctcccaagtagctagaactacaggcacacaacaccatgtccagctaatttttgtatgtatatatatatatatatatattttttttttttgtagagatggggttttggcatgttgcccaggctggtctcaagctcctgggcttgagaccagtcctccccaccagcctcccaaagtgctgggattacaggtgtgagccactgctcctggcctaattcctctcattaactaccaaatgaagtccaccacccctggctaattttaaaaaattatttaggagataggggtctctccatgttgctcaggctggtctcgaactcctggcctcaagcaatcctcttgtttcaccctcccaagtagctgggattatagatgcaagccaccatgttcagtttagattgtacaatttcttttctttttttcttttcttttttttttttgtttgagatggagttttgttcttgttgcacaggctggagtgcaatggcacgatcttagcttatggcaacctctggctcccgggttcaagtaattctcctgcttcagcctcccgagtagctgggattacaggtatgcaccaccacgcccggctaattttttgtattttgttttagtagagacggggtttcttcacgttggtcaggctgttcttgaactcccgacctcagctgatcctcccgcttcagcctcccaaagtgctgggattacaggcgtgagccactgcgcccggctagatcgtacaatatcttgaaggccattatgctggtgtcttccctttgaagccctcttatattttgttggtgcaaaagtaattatggggtgggcatggtggctcacacccataatcccagcactttgggaggccaaagaggggtggattacttgaagtcaggagttcaagaccagtcttaccaatgtggtgaaaccctgtctctactaaaaatacaaaattagctgggaagactagtttcctagacggggtttcaccatgttgtccaggccgatctcgaactcctgaccttgtgatccgcccacctcagcctcccaaagtgctgggattacagccagccaccgcgagccaccgcgcctggccttattttttattttatcttttttagagacaggatcttgttctgtcacctaggctggagtgcagtggcctgatcatagctcactgcagcctcgaactcttgggtttaagtgatcctcccacctcagcctcctgagtagctaggactacaggcacacatacaccacccctggtggtgtgtgcctgtagtcccaaaccagtctgaaaagatagatgtgggggccaggcgcagtggtgatgcgcgtctgtagtcccagctacaggactgaggcaggagaattccttgagcctaggatttttgttttgttttgtttttttgagacagaatctcgctctgtcgcccaggctggagtgcagtggtaagatctctcagctcactgcaagctccacctcccaggttcacgctattctcctgcctcagtctcccgagtagctgggattacagacgcctgccaccacgcccggctaatgttttgtatttgtagtagagacggggtttcaccgtgttagccaggatggtctcggtctcctgacctcatgatccgcctgctttggcctcccaaagtgctggtattacaggcgtgagccaccgcgcctggcatgagcctaggagttcaaggctgcagtgagctgtgattgtgccactgcacttcagcctgagcgatagagcaagacctacaaaaaacaaacaaaacccaaaacagaatcacatgtaacacacagctgtggactgattggttgacaaaagtgtggtgatcagaggctggcaggaacttcaccatgtatttccgctagaagcaatgttcagtattctctaattcattgtttgtggtgactttggggaatataaccaccacagagacaagaatcaactttgaatgtgtcatcccaccacctgctggcttccgttgtttctgatgagaaatcaactgtcaatctcattggagtttccttgtacgcgatgagttgtttttctcttgctgctgccaagagtctctttttgtcttgtttgtttatttatttatttatctaatttatttattttgagatggagtttcacttttgttgcccaggctgagtgcaatggcacaatctcaactcactgcaacctctgcctcccgggttcaagcaattctcctgcctcagcctcctgagtagccaggactacaggtgtgcgccaccatgcccagctaatatttgtatttttttttttaaattttttgagatggagtctcactctgtcccccaggctagagtgcagtggcgtgatcgtggctcactgcaaactctgcttccctggttcaagcgattctcctgcctcagtagctaggattacaggcacatgccaccacacctggctaattttttatttttagtagaggcagggtttcaccatgttggccaggctggtcacgaactcctgacctcaggtgatccatccaccttggcctcccaaagtgctgggattacaggtgtgaaccgctgtgcccagcctaatttttgtatttttggtagagtggagtttcactatgttggccaggctggtctcgaactcctgacctcaggtgatccacctgcctcggcctcccaagggttgggattacaggtgtgagccaccatgcctggcccttggggtctctttttttatgaactgtctgtcccactgggcaaagcctctgagaccctattttggacactggtggagcagtagcctctggttttcgtggcttgcccctcctggcatgggatctctgttccacaagcaagctgggaggagtgtgattatggtcccagtattcttggactgtcactgatggtacagccttcattctatggtgtgggcgagtgctgggtggaggagaagagtgccctacttctttaccacgttcaccagaaatgtagcctcttcaatttggagttggaggggatgaaaactggtggcagcatgctcctcctggtgagatatggtaagccttgattggcagctgaggggagagggagcttgtcttcttggccacatctactcagagagcagtttccttccagctgaactgtggggggagggcagtcaggagatagttggtcctcctggcttaaatgccacagatggcctggcacagtggctcataatgttacaggtagttaaacaggcatgagcagggctggagagggctcttccccacccaccaggaatgtcaagtgatggttcaacaatgatcacattgcctctctaaataatttggcagccagcgccagagagagagacaagctcctgatggtccacagctgttatgttagagtgttaattgaatgcagacaccagggagaagcaatttcctggacatgtgcattaagagacaaaatagtctgggcacggtggctcacacctgtaatcccagcaatttgggagactgaggcgagcggatcacctgaggtcaggagttcaagaccagtctggccaatgtggtgaaacccccatctctactaaaaatacaaaattagccaagcgtggtgttgggtgcctgatatcccacctactcaggagactgaaggaggagaattgcttgaacccaggaggtggaggttgcagtgagctgagatcaggccactacactccagcctgggaaacaagagtgaaactgtctcaaaaaaaaaacaaacaaacaaaaaagaaagagacaaaatgatggagcatgaccttccggggtcagaccaccggaaaagggaagaaaacctcagataggcatgcatacaacttcctacacacactgtgcatgctcaccttcccagggtaaggaggccactgtgcatgcaggcagcccatcctaagggaagaatcatgggaaaggagccagcctataaagtcctaggatcaaggttgaacaccacgcttgaccttggtgcccacttgagtctcttccaaatgtacttacctttctttcccattctaaagccatttaaaataaacttccactcctgctctgaaacttcccttggtctctttttctgccttatgccctgtggttctttcttctgtggaggcaagaattgaggttgctgcagacccgtacagatttgtcaccggtaacttggataacctttcaccgataacaatgcttataatcccagcactttgggaggccgaggtggcaggatagcttgagcccaggaatttgagaccagcttgtgcaacatagtgaaaccccatctctacaaaataataataataaaagtaataaaattcaatgccacagattctccctgttcttactgagttttagtagattttcttgaataagaaagtgagccaagattgcaccactgcactccagcctgggcaacagagcaagactccatctcaataaaaaataaaattaaatgtttattcatctgttatatgacattaggataattccagaaactttaagtgtttatttatttttaaatggttttcaccagctttgcttgttttgctggggaaaagatcctcagagctccggcactgtcatcttagagctttgatgtcccccagtgtattaatccattcttgtattgctataaatacctaagcctggataatttataaaggcaagaggtttaattggctcatggttctgcaggttgtacagggaacatgatgctggcatctgcttggcttctggggaggcctcaggaaacttacaatcatggcagaaggtgaagggagaacaggcatgtcacatggcaggagcaggagcaagagagcaagggaagaggcgccacacactttacttattttatttttattcatttattttgagatggaatctcactttgtcacccaggctggagtgcagtggcactacctcagctcactgcagcctccatctcttggattcaagtgattcttttgcctcagcctcctgagtagttgggactacaggcatgcgccaccactggctttttttttttttttttttttttttagacagagttttgctcccgttgctcaggctagagtgcaatggcaccatcttggctcaccgcaacctccatctcccaggttcaagcgattctcccacctcagctgccaagtagctgggattacaggcatgcgccaccacatccggctaattttgtatttttagtagagacggggtttctccatgttggtcaggctggtatcgaactcttgatctcaggtgatctgcccgcctcggcctcccaaagggctaggattacaggcgcgagccaccgtgcctggccaatttttttttttttttttttagatggagtttcgctctcgttgcctaggctggagtgcaatggtgccatctcggctcactgcaacctccgcctcctgggttcaagcaattctcctgcctcagcctccctagtagctgggattacaggcatgcgccacctcgcctggctaattttgtatttttagtagagatggggtttctccatgttggtcaagctggtctcgaactcctgacctcaggtgatccacctgcctcggcctcctaaatagctgggattacaggcgtgagccaccacatctggcctaatttttgtatttttagtagagacgggcgtttcaccatgttgcccaggctggtctcgaactcctggcctcaagtgatctacccacctcggcctcccaaagtgctgggattacaggtgtgagccactgcgacccgccttcacacacttttaaacaaccagatctcttgagtactcactcactgtcaagagaacagcaccaaagggatggcgctaaaccattcatgagaaaccccacccccatgatccaatcacctcccaccaggccctacctccaacactggggattgcaatacgacatgagatttgggtgggcacacagttctaaaccacatccctcagcttttcctttcaggcttttgggttagtctattgcttgctccaacacctgtctactacttcagacagtctcaaagttaaaaatcctacctgttatccaatgaagtctccctgaaaaaaaatcttgcctgtaaatgtttctgatgaatgcctcctggggagagggccttttgcactgggccagctccagtgaggtcacatacagatggacttgcaagtggagtcttctagggaacctcaagacagctccagtaatgacagttctttggaaacacaactttgaaagaactccagctccgttttactccctcagggggctgccaggttgctctgagaatgtgggctgttattttttaaggttgcaacagagctggaggctgtgggctgggactagggcaatttttttttactttatttatgttacctttcttttttgagacagggtcttgctctgtcgcccaggctggagtgcagtggcacgatctcttctcactgcagtctccacctcctgggttcaagtggttcttctgcctcagcctcacaagtagctgggattacaggtgcacaccaccacgcctggctaacttttgtattttttggtagagatggggtttcaccatgttggccaggctggtttcaaactcctgacctcaagtgatccacctgcctcggcctcccaaagtgctgggattacaggcgctcaagccaccttgcccagccactttttaaaatttcttgaaagccacaacaagatttgcctatccccggtactttccccatttttaaaaatttctcaaaggtggtcttcagtggttccaaaactttatcttagaaactttcagcattttgaggggtggactgcatccaaatctggggtcttgaacatttcagttgagttagtgtcctattatcattctccacttctttggggcttcaatttccactgaagtgtggacctaaaagcattttaatcttgagtgtcattctctttacagaaaacacaggctgggcactgtggctcacgcctgtaatcctagtactttgggaggctgaggcaggcggatcacgaagtcaagagattgagaccatcctggacaacatggtgaaaccctgcctctactaaaaatacaaaaattagctgggcgtagtggcacacgcctgtagtcccaactactcgggaggctgaaacaggagaattgcttgaaaccaggaggcagagaggttgcagtgagccgagatcatgccactgcactccagcctggcgacagagcaaaaatccatctcaaaaaaaaaaaaaaaaaaaaagagagagagagagaaaacacaaaccaggcttgacacagtggctcattcctgtaatcccaggactttaggaggctgagacgggtgaatccttgagcccaggagttttttcttttctttttctttctttttttttttttttttttttttttttttttttttttttgagacggagtctcactctgtcgcccaggctggagtgcagtggtgtgatctcggctcactgcaacctccgcctcctgggttcaagcaattctcctgcctcagcctcccgagtagctgggactacaagcgcatgccaccacgcccagctaatttttttgtatttttagtagagacgaggtttcaccatgttagccaggatggtcttgatctcctgacctcatgatccgctcgcctcggcctcccaaagtgctgggattacaggtgtgagccaccacacccagccaagtttttttcttttcttttctttctttcttttttttttttttttcctaagacggagtctcattctgtcgcccaggctggagtgtaatggtgggaactcaactcactgaggcctctgtctgctaaattcaagcaattctcgtgcttcagcctcccgagtagctgggattataggtgcgtgccaccacgcccggctaatttttgtatgtagagacggggtttcaccctgttggctaggctggttgaactcctgacctcaagtgatctgctcacttcggcttcccaaagtgctgggattacaggcgtgagccactgtgccaggccgagccaagagttcaaaactagcctgggcaacataggaagactccagctctataaataaataaataagctgagcatggcagtgcatgcctgtagtcccagctacttgggaggctgaagtgggaggatccctggagcctggaaggtggaggctgcagtgagctatgattgcaccactgcgctccagcctggggaacagagtgagagagcctgtctcaaaaaaaaaaaagaaaaaagaaagaaaaaagaaaaaagagaaactaaatgaaagtggagagcttctgcttcctcttggtcatctgttcgtattacaacatctaccctaagcaatgggcctatttcttcctttttcttgatccagatatagctatcaaagccctttttgttgtctatagcatgttttgtaatctcagctcattccgagttacagccatcccgacactgttctcataggtttatgctcagcttttgtgtttatccctgggttacgcggctcttcttacatcttcttttattacagaacttcctgtgcagccgctttggctcctataaatgctattccgattgcctcttcatcaggacccaaaagggatgaaggagtggctggttttttggggaggcgggaggaggttggatattcttgaaatgataaataaaatgatacatattagttcagtattggaacacagataaatatttagcacatgcaatgagataattgttcattaatttagcatcctatgattaatttagcatcctaatagtcataggcattgtcttgttcacctcaagtacattaatacacaattacatactgctttttcccttagctttcatttatttacgactgtgtggtaaacgatcctaaaatttagtggcatgaaacaaccaccttttaaaattttttttcaaatgctcgttgattctgtgggtggagtttgggaagggcaaagtgggaaaagctatactctgctctgtgatgtctgagcctcagcctcagatggggtgacccgaacagccaacagtaactctaatggatggggagggaacagccggggctggggatctgcttcgcagatggctgctttagtcacatgcctgttgcctgcgctgcagtggcaggagggtaggctcaggcccaaaggggactgaaaaccacgcagcctgtgtgtaagggggcaacccgtatgcgaaagcacagttggactttttttttttttttttttttgagacaagagtctcactctgtcaccctggctggagtgcagtggtgtgatctcaactcactgcaacctctgcctcctgggttcaagtgattctcctgcctcagcctccgagtagctgccattacaggctcccaccaccacacctggctaatttttgtatttttagtagagatggggtttcaccatgttggccatgatggtctcgaactcctgccctcagaggatccacctgccaaagtgctgggattataggtgtgagccaccatgccaggccttttcttttctttttttctgaggcagggtctcagtctgtcacccaggctggagggcagtggtgcaatctcagctcactgcagtctctacctcctgggctccagcaatcctcccatctcagcctctcaactacaggtgtgcgccactatgcctgtctaactttttttttttttttttttttttgagaaagaatttcgctctccttgcccaggctagagtgcaatggcgtgatctcggcttactgcaacctctgcctcccaggttcaagtgtttctcctgcttcagcttctgagtagctgggattacaggcatgcaccaccatgcctggctaattttgtatttttagtagagacggggtttctccatattggccaggatggtctcaaactcctgacctcaggtgatccgcccgcctcggccttctggctaatttttttacagattttttgtggagactcagtacattgcccaggccggtctggaacttgtgggctcaagtcatcctcccacttatgcctcccaaagttctgggattacaggtgtcagccactgcacctggccggccggccttccttccttccttccttctttccttcctttcctttctttttttgttgagacggagtctcgctctgtcacccaggctggagtgcagtggtgcaatctcagctcactgcaacctctgcctcctaggttcaagcaattttcctgcctcagcctcccaagtagctgggattacaggcgtgcgccactgcgccagctgatttttgtattttcagtagagacagggtttcaccatgttggccaggctggtctcgaactcctgacctcaagtgatctgcccacctcagcctccaaagtgctgggattacaggcatgaatcacggcacctggcctcctggcttttctttttctttgagacaaggtctcactctgtctcccaggctggagtgcagtggtgtgatcattgctcactgcagccttgaactcctgggctgaagcaatcctcccatttcagcccctcaagtggctaggagtacaggtgcatgccaccatatccagctaattttttcaattttttgtaaagatggagtcttatcatgttgcccaggcttgtcttgaactcctgggctcaagtgatcctcccgcctcggcctcccaaagtgctgggattataggcatgagccgctgaagctgggctctataggcgtattatgaaaaaccagggctccttcatgacccatttcctgttccccagaggcaagaacgttccaccgctttggctgggccattggtattgacttccatgtctctaaacagcatgttcatattgtacttgctgatttctcggttttaggcactacctgttatcattttgaaggttgaggctttacaattcttccacctctccccgacagcccacatctctattcctacatatgcacgtgtgcacttcctgttttcattcttccatgtcactgtgcctcggttctgggtacacagatattcagagtctatatcctatagctatgtaaacactgttcacagctgaaccatgccctttccacaaacacttcttccctgcactgtttgttccttctttcccctccaccacactgagttcattatgtcacattttagctgctgtgtttttttgctatgtaacactagttcaatcctgaatgctaccttgagatgtcaatcctttatcacattcaaacatattccattttctattggttttatttcatattattttgttttgttttattttgagatagggtcttgctctgtaccggaggctggagtgcagtggtgcaatcacagctcactgcagcttcagcttcctgggctccaagcagtcctcccacctcagcccccagaatagctgggactacacatgcgtgccactacacccgactaatttttaaattttttgtagagacagggtcttgcaatgttgcccaggctggtcttgaattcctgagctcaagtgatcttcctgcctcagcctcccaatgtgctgggattactggcatcagccacctcgcccagctgcaccatgtatgcatttctaaacaggcttagttcctgcctgttttgggctttataagaacgcactcatggccagacacagtggctcacgcctgtaatcccagcactttcagaggccaaggtggatggatcatgaggtcagaagttcgagaccagcctggccaacatagtgaaaccctgtctctactaaaaatacaaaaattagccgggcatggtcttgcacgcctgtagtcccagctactctggaggctgaggcaggagaatcacttgaacccgggaggcagaggttgtggtgagccgagattgtgccactgcactccagcctgggcaacagagctagactctgtctcaaaaaaaagaatgcactcattgtaggctgggtgtggtagctcacgcctgcacgcctgtaatcccacactttgggaggctgaggcgggtggatcacctgaggtcaggagttagagactagcctggccaacatagtgaaaccccatctctactaaaaatacaaaaattggccaggcgcacatctgtaatcccagcactttgggaggccaaggcaggcggatcatctgaggtcaggagtttgagaccagcctgaccaacatggagaaaccccgtctctactaaaagtacaaaaaattagccgggcgtgatggcacaaggctgtaatcccagctactcgggaggctgaggcaggagaattgcttaaacccagaaggtggaggttgcggtgagccgagattgcaccactgcactccagcttgggtgacagagcaagactccgtctcaaaaaaaaataaataaataaaaagttaattgtgattgtggtagaatacacacaacataaatgtacctttttttttttttttttttttgagacagagtctcgctttcttggccaggctggagtgcagtggcacgatctccactcactgcagcctccatctcccaggctcaagcaattctcctgcctcagcctcccgagtagctgggattacaggtgtgtgccaccacgtccggctaatttttgtatttgtagtagagacagggtttcaccatgctggcctggctggtctggaactcctgacctcaggtgatccacccactttggccttccaaagtgctgggattacagatgtgcgcctggccaatttttgtatttttagtagagatggggtttcaccatgttggccaggctagtctccaactcctgacctcaggtgatccacccgcctcggcctcccaaagtaccatctgagccattttttagtgttcagttcagtggtgttgagtacattcacactgtggtgcaaccaatctccagaactcttcatcttgcaaaactgaaactctgaacccactaaacaacaactcccctctctcccctcccctcagcccctggcaaccatcactctactttctatctctatgactctgactccaggtacctcacataagtggaatcatgcagtatatgtcttttggggacagggttatttcacatagtataatgtcctcaaagttcagccatgttgtagcatgtatcaaaatttcctattttaaaaaaaattctgaataatattccactgtatgtaggtagcacagtttgtttatccattcaccctttcagcctctgtctttattattattattattattttgagacagtcttgctctgttgcccagactggaatgcaatggcgagatctcagctcactgcaacctccgcctcccgggttccagtgattctcctgcctttgcctcctgagtagctgggattacaggtgcccgccaccatatgcctggctaatttttgtatatttagtagagacggggtttcaccatgttgaccaggctggtctcgaactcctgacctcatgacccgcccgcctcggcctcccaaagtgctgggattacaggtgtgagccaccgctcccgaacctgtcttctatattggatgccttcctcaaacgtggtgaatcttgggggtctgtgcatactaaagctggagctattaaaagccttttaaaagttccccaggctgagggcacagtggctcatgcctgcaatcccagcactttgggaggccaagacaggtggatctcttgagtccaggagttcaagaccagcctgggtaacataacaagacctcatcgctacaaaaaataaaaaaataaagctgaccatggtggctcacgcctgtaatctcagcactttgggaggccaaggcgggcgggtcatgaggtcaggagttcgagatctgtctggtcaacatggtgaaaccccatctccattaaaaatacaaaaattagccaggcgtggtggtggatgcctgtaatcccaactactcaggaggctgaggcaagagaatcacttgaacagggaggcagaggttgcagtgagctgagatcgtgcctctgcacttcagccggggcgacagagtaagtctccatctcaaaaaaaaataagaaaaaaaataaatcaggcacggtggtgcacacttgtagtcccagataccaggaaggctgaggtgggaggacgatcgagcccacgagtttgaggttgcagtgagctgtaattgtgctactgcactgcagcctgggtgacagagtgagacccaatctcaaaaacaaacaaacaaacaaaaaaaaaacctctctccactgtgtggcactgtgtgctagggggtgaccttgctggtggcttcccagggagctcctgatgtcagtgtcttcaggactttcctcttggcttgatcacagtcccttcagaagattcttccaattcctgcctgaaggtgccaatttctatgtcttttgtggcttctgcaaagaaaacctagcaatttctcattttttccaatgccagctcgattccacttccttggttctagtaaattggttaccatgagtccctctattagtacctggcttaaacatttttgttcgtattgtcttctttcctattcttactcttcctgtgggtgtgtggcattagaaagattctcttactgccattttattatgtttggggcaagaacagaagtaaatacatgtgtttagtctactatctttaacctgatgccttttaacttttttttttttttgaggtggagttttactcttgtcacctaggctggagtgcaatggtgtgatcttggctcactgcaacctctgcctcctgggttcaagcgattctcctgcctcagcctcccgagtagctggggttacaggcgcctgccaccatgcctggctaattttttttttttttttagtagagacagggtttcaccatgttggccaggctggtcttgaactcctggcctcaggtgatttgcccgcctcggcctcccaaggtgctgggattataagcgtgagccactgtgcctggccccttctaactttttaaaagtaaaccttgtcttggttaggcatggtggctcatgtctgtaatcacaaaattttgggaggctaaggcaggaggattgcttgaggccaggagttagagaccagcctgggcaacagagtgagactgtctctacataaaatttaaaaaaatagccaggtgtggtggtacatgcctatagtcccagtgctttgggaggccaaggcaggaggatcacttgaacctaggaattcaaggccacagtgagctgtgattgcaccactgcattccagcctgggtaacagagcaagaccctgtcttgaaggaaaaaaaaagagttgtcatattcttaccacatcattatccacattatccacaaagcaaagatatggaatcaacctaagtatctatcaatggaggagtggataaatcaactatggtatgtatacagaatggaatactatttgactataaaacagaattaggctgggcatgatggcccacacctgtaatcctagcacattgggaggcgaacacaggtggattgcttcagcccaggagttcgagaccagcatggccaacatggagaaaccccacctctactggaaaaaaaaaaaaattagccaggcgtggtggcaggtgcctataatccctgctacttcagagactgaggcaagagaattgcttgaacctgggaagcagaggttgcactgagccaagatcactgcactccagcctgggccacagagcaacactcagtctcaaaaaaaaaaaaaaaagttttaatatctgatagcagagtagggtgattatagttggctgcaatgaattgtatatttcaaagtaactagaagagaacttgaattactcccaacccataggaatgagaaatactcaaggtgatgagtaccccagataccctggcttgatcattacacattctatgcatgtaacaaatactctcatggaccccataagcatggtgtatatatatatgacatatatgatatatcatatgcaacacatattatatcatatatgatataatatatgtgatatatcatatatgatatataatatatgtgatatatcatatatcatatataatatatgcgatatatcatatatcatatataatatatgtgatatatatcacatataatatatgtgatatattatgtatcacatataatatatgtgatatattatgtatcatatataatatatgtgatatattatgtatcatatataatatatgtggtatattatgtatcatatataatatatgtggtatatgtgatatatattatatatgatatgtgtgatatattatataatatatgtgatatattatatatgtgagatatatataatatatatatttcttttttagacagcatcttgttctgttgcccaggctggagtgcaattgcacaatcttggctcactgcaacctccgcctcctggtttcaagcaattctcctgccttagcctcccgagtagctgggattacaggcgaccgccaccacacccagctaattttagtatttttaatagagatggggtttcaccatattggtcaggctggttttgaattcctgatgttaggtgatccacctgctttggcctctcaaagtgctgggattacaggtgtgagccactgcgcctggcctggaatacattatgtatcaataaaaaaaaacaggagttgtgtggagaacaattggagcagcagatggcaaagaagaccttgagggctgggataagaagactggattttctgctagaaggaatgagagcattttatcatgttagtcagcttcagagccttgcagtaaaaacatttgcacatttgaatgttgatgaagacatttacaaatatagacaggatgtgataatttgtacttttccctcatccccggttggtgtgagtgatgtcattgattgcaccagttaacaggtgaaaaaatagaagtttgggatgtcaggattgtacctgatgcttgagcatcataggtggatgtgaaggaaaaggaaaacatgatcaagggctgagcaatctgggccacaggaatatcaaactcatttaccaatgtgtgcagccacccttaggctgcatgacagattgaggacagagcttatctgggcactcattaattgaaaggaggagatcagtgagaagaagtagagaaaacaaactacttgtcagttcaaacttaatcactttgttttttgagacagagtctcgcactttcgcccaggctggagtgcagtggcatgatctcggctcactgcaagctccgcctcccgggttcatgccattctcctgcctcagcctcctgaatagctgggactacaggcacccgccaccacgcccggctaattttttgtatttttagtagagacggggtttcgccgtgttaaccaggatggtctcgatctcctgaccccgtgatcccccgacctcggcctcccaaagtgctaggattacaggtgtgagcccccgcgcccggtcttttttttttttttttttttgagacaaagtcttgctctgttgtccaggctggagtgcagtggcatgatgtcagctcactgcaacctctgcctgtggggttcaagagattctcctgcctcagcctcccaagtacctgggattataggcacccgccaccacacccgactaatttttgtatttttagtagagacagggtttcacatgttggccaggctggtctccaactcctgacctcaggtgatccacctgccttggcctcccaaagtgctgggattacaggtgtgagccaccacgtccagctttttttttttttttttgagatgtagtcttgctctgtcacccaggctggagtgcagtggctcaatctatgttcactgcaacctccgcctcctaggttcaagtgattctcctgcctcaaactcctgagtggctgggattacaggtgcgtgacaccacgcccagctaatttttgtatttttagtagagagagggttttaccatgttggccaggctggtctcaaattcctggcctcaggtgatctgcccggctcaggctcccaaagggctgcgaatccaggcgtgagccaccgtgcccggcccggtttatattttagaagggtaatacagtaagttgacagtaagagagcccttatctcttttcttttccttttttgttctcctttcatattccatcattgaaaggtaggaacatacagcataacttaaaattaggaacagagttcacatataactttttttttttttttttttgagatggagtcttgctctgtcaccaggctggagtgcagtggcgcaatcttggctcactgcaacctctgcctcccaggttcaagcaattcttctgcctcagcctcttgagtagctgggactacaggcacgtgccaccacacccagctaattttttttgtatttttagtagagacgcggtttcatcatgttggtgaggctggactcgatctcctgatcttgggatccacccgccttggcttcccaaaatgctgggattacaggcatgaaccaccacacccagccaccttttttttttttttctttttctttttgaagacagaatcttgctctgttgcccaagctggagtgcagtggcgcaatctcagctcaatgtagcccccacctcctgggttcaagtgagtctcctgcctcaggctcccgagcagctgggattacaggcatccgccatcacacctggctaatttttgtatttttagtacagacgaggtttcaccatgttggtcaggctggtctcgaactcctgacctcaagtgatccgcccgcctcagcctctcaaagtgctaggattactggtgtgagccactgcgcctggcccatataacctttttaaaaaataacagctttattggaatataaaacatacaccattaagtttaccctttcaaagtgtacagtttggtgggtttggtttttagttgattcacaaagttcatctgtcaccactatgtaattccaaaatattttcaccccaggaagaaactctatactaattggcagccactccctgtcccctccctactccccaagtccctggcaaccactaatctaattattgtctccatggatttgcctattctggacagaccacatgtaaagtttttgcttaatctgattaattgataggttccacttttacagataaatagcttttcatgtcagcaaaaatgaaagatttaaaatgtagtactaggctggtcacagtggctcacgcctgtaatcctaacactttgggaggccaagctaggtggatcacttgagctcaggcattcaacaccagcttgagcaacatggcaaaacccggtctctacaacaaatacaaaaaattagccgggtgtggtggtgcatgcctgtgctctcagctcccagctacttgggaagctgaggtgggaggatcacttgaccctgggaggcagagattgcagtgagccaagatcacactactgcattccagcctgggcaacagagtgagaccccatctcaaaaaaaaaaaaaatatatatatatatatatgtagtacctgacctcccccaaagttatttgaggttcaaatgatttatttcagcctccacttaactagagctgacctcttattagacaccttggggacattactatgagccttaaagaaataaaaagtattataaaggaatacaataaatagttgtatgccaattaattaaacaacttagaaaaatggacaaagtcctagaaaaacaagaaaaacctaccaaatttcaggaagaaatggaaattctgaatagacatataacaagtaaatagattgaagtagtaataaaaaacttcccacaggttggcgtggtggctcatgcctgtaatcccagcactttgggaggccgaggtgggcagaccacgaggtcaagagatcaagactatcctggctaacaccgtaaaaccccgtctctactaaaaaaaaattagccaggcattgtggtgggtgcctgtagtcccagctacatgggaagctgaggcaggagaatggtgtgaacccaggaggtggagcttgcagtgagatgagatcgtgccactgcactccagcctgggcaacagagcgagactccctctcgagagaaaaaacaaaaacaaaaacaaaaacttccacaaaggctcatgcccacagggcttcactgctgtatttaactaaacatttagagaaaaattaataccagtttttcataaactctttcaaaaaatagaagaagaggcaacatttcccaactctttttatgaggccagtattaccctgatgccaaagccagacataagaaaggaaactacagatcagtatttcttattaatatagaggcaaaaatcttcaaataccagcagacagaatccagcaccacatcaaaaggacagtacaccatgatcaagtgcgaatgatcccaggaatgcaaggctggttcaatatctgaaaatacattaacttaatacaccataattttagaataaatggaaaaaagcaattaatcatctcaataaatgcagaaaaaaactttgacaaaattcaacattctttcgtaagaaaaaaaccatgcaacaaactacaagtaaaagacaacttcctctacctgataaagagcatctgtgaaaaacccacagctgacatcatacttaatggtgaaagttcctgacagatcaaaataagacaaggaagtccgctcttaccacttttattctgtattgtactggagattctagccaggaaaattaagcaagaaagtgaaataaaaggcatctagattggaaagaaagaagtgaaactatctatagattacatgatcttgtatatagaaaatatacaagatccaaggccgggcgtggtggcttatgcctgtaatgccagcatttgggaggccaaagtgggcagatcatttgagatcagcagtttgagaccagcctggcaaacatggtgaaactccgtctctactaaaaatacaaaaaattagctgggcatggtggtgcacacctgtaatcccagctactcagagtctgaggcaggagaatcccttgaagctggtaggcagagtttgcagtgagctgagatcgtgccactgcactccagcctgggtgacagagtcagactctgtctcaaacaaaacaaaacaaaaacaaaaaaagaaaatatataagatcctgtaaatcctaaggaacccactaaaaaatcagaactttaatcgccagggaaatgcaaatcaaaacctctgaagaaaaaacacaaactgttttttttcttggctctcacaccacagtaacaatcactacagaagtcttctgtgaccgggctgggtgcggtggctcacatctgtaatcccagcactttgggaggccaaggtgggtggatcacgaggtcaggagttcaagaacagcctgaccaacgtggtgaaaacctatctctactaaaaacacaaaaagaatagccaggtgtggtggcaggcacctgtaatcccagctactggggaggctgaggcaggagaaatgcttgaaccagggaagcagaggttgcagtgagcagagatcacaccactgaactccagcctgggcaacagagtgagacttggtctcaaaaaaaaaagaaaagaaaaggaaaagaaaaaagaaaaaaaaaagaagtcttctgtgaccaaatgttggggggaactcctgccaacaccaagcaaacaaccaattctccaatggacaattctgaattgagtgtcctccaattcaattccaacactatctacctgaagatagcatcagatcccacaagttgagggttcaatcccacaagactgcacccctacacacaccagaacttctgaccgactggcttcaaattggggtttccatgattccctcttttttttttttttttttttttttttttgagacagagtctcctctgccacccatgctggagtgcagtggcagagatctcagctcactgcaagctccgcctcccaggttcatgccgttctcctgcctcagcctcctgagtagctgggactacaggtgcatgccacaacgcccagctaattttttgtatttttagtagagatggggtttcactgtgttagccagagatggtttcgatctcctgacctcgtgatccgtccgcctcggccttccaaagtgctggggttacaggcatgagccaccatgtctggcacagctctctctttagtgagagtggggacttctgagaggaaaagaccagcaggtgggggatgtgccatattttatagtcagatttgaggatgtggtgcctgatttacataggactcacagattggtttgatcaagagtgatattacatagcatgcagggaaggctggctgcctcaccctaatcatattatgcaaatgaactttccccttggccttcgccatcttgtctgctctttactgtacacgtggctgacaaagagaagggaagatggagccaccatcttgaacatgattggcacaactgccaacatctatgtctgcagctcgattttacaggctactcttcgttagaaaggaaaataatttggggctgcttttcattaaaaggagaaccttaccaaagacttctgtacccttactatctgcctaagtaatttcttcttaactcctgtatgacctccacatggtcagctatccggaagctccctaagccctgtccttttggccttttatggagacttaattggataggcatgactcaagcatggacaaatgtgtagaaaggtgattggtcaaaaagggcacgatctaatactaataccctgaatggggaaccccagcaaggcccttgtgttcagcaactccttggcctctctgtgcagctttccttcctccagggtatgggcaggagtcctaccgaaatgaaggtgtcatcaactacactcagacaaggtatgtcagagagtttctttatggccaatttcaatacagaaaggtaggggaagattcctgccttggtgagaaaaagaagcaggtgaaaggagagcaggagaaggtcaaacagagagagagagtttttttttttttttttgagacggattcttgctctgttgctcaggctagagtgcagtgatctccgctcacactaacctccgcctcccaggttcaagcgattctcctgcttcagcctcctaactgggactacaggcgcccgccaccacacctggctaatttttgtatttgtagtaaagacggggtttcaccatgttggccaggctggtcttgaactcccgacctcgtgattcacccaccttggcctcccaaagagctgggattacaggcatgagccaccacacccagccaagagattcttttttcaatgaggcctgcttcagaggattgcagcactccagcattctagcaagagctatgggagctgtgaaccaggaactgtggacaaaatctagatgtatatatatatatatcaccaaatcacaatgaggtgctgcctcatacctgttacgatggccactatagaaaacaaaaacaaaaaacaccaaaaccagaaaatacgtgtggcaagaatgagagcgaattggaaaccccgtgcactgttggtgggaatgtaaaatggtacagctaatgtggaaaactgtgtgaaagttcctcaaaatattaaaaatagaactaccatatgatccagcagtcccacttttgggtatttatttatttatttatttatttatttatttatttatttttgagacggagcttcgctcttgtcacccagaatggagtacaatggtgcgatcttggctcacaggaacctccgcctcctgggttcatgcgattcttgtgccttggtctctcaagcagctgggactacaggggtgtgctatcacgtccagctaatttgtgtgtgtgtgtgtgtgtgtgtgtgtgtctgtgtatgttttttgagacagagtctcactctgtcgcccaggctggagtgcagtggtgtgatcttggctcattacaacctccatcttccgggttcaagtgattctcctgcctcagcctcctgagtagctgggattacaggcatctgccaccatgcagactaatttttatatttttagtagagacggggtttcaccatgttggccaagctggtctcaaactcctgacctcaggtcatccacccacctcagcctcccaaagtgctgggattacaggcatgagccatgtgcccggcctaatttttgtgttttcagtagagacagggtttcaccatgtcagccaggctggtcttgaactcctgacctcaagtgatccacacacctcagcctcccaaagtgctgggattacaggcatgagccacgtgcccggcctaatttttgtgttttcagtagagacagggtttcaccatgtcagccaggctggtcttgaactcctgacctcaagtgatccacccacctcggcctcccaaagtgctggaattacaggtgtgagccactgcgcctggccacttctgggtatttatccaaaagaattgaaatcagaatctcaaagagatatctgcattcccatgttcatttcagtattatttacaataatcaagaggtgtacacaacctaaatgtccactaacagatgaatggataaagaaaatgtgaggccaaggtgggcggatcacgaggtcaggagattgagaccatcctggctaacacggtgaaaccccatctctactaaaaatacaaaaaattagccaggtgtggtggcgggcgcctgtagtcccagctactcaggaggctgaggcaggagaatggcgtgaacccgggaggtggagcttgcagtgagctgagattgcgccactgcgctccagcctgggtgatggagcaagattccatctcaaaaaaaaagaaagaaagaaagaaagaaaatgtggcacagacatacaatggaatattattcagctgtaaaaaggaggaaatcttgtcatatgctacaacacagatgaaccctgaagactgatacagtttcgatgtgtgtctctgcccaaatctcttgtagaaatgcaatccccaatgttggaggtggggcctgtggggaagtgtttggatcacgggggcagatccctcataaatggcttgcgccatctccttagcaataagtgagcccttactctgagttcacacgagatctgactctttaaaagttagtggcacccctcctcaccctctcgctgtcttgctcctgttttcgccatgacatgcctgctccccattcgccttctgccatgattttaagtttcctggggcctccccagaagccaagcagatgccagcaccatgcttcctgtacagcctgcagaaccatgagccaattaaacctcttttcaccgtaaattacccagtctccggcatttctttatagcaaagcaagaatggcttaagacaaagacattatactaagtgaaataaaccagttatagaaggacaaaaactgcatgattccactcatacgaggtatctaaagtagtcaaactcaccaaaacaaaaattagaaaggtgatgttcagcagctgaggggagggggagaggaggagttgctgtttattgggtatcgagtttcagtcatgcaaaatgaaaaattttagaatctgctgcactacgttgtgatcgtagtttaaagtactgtacacttaaaacttgctcgggtccaggtgtggtagctcatgcctgtaatcccagcacgttaggaggccgaggcgggcggatcacgaggtcaggagatcgagaccatcctggccaacatggcaaaaccccgtctctactaaaaaataaataaataaaaattagctggggatggttgcgtggcatggaggctgaggcaggagaattgccggaacccgggaggcagaggccacagtgagccaagatcgtgccactgccccctagcctgggcgacagagtaagactccatcaaaagcaaacaaacaaacaaaaatcaacaacaaaaacttgctaggagggtacatctcatgttatatgttttatcacaataagaaaataaaactggccaggcacagtggctcacacctgtaatcccagcactttgggaggctgagatggaaggatctcttgagcccaggagtacgagaccatcctgggcaacaccgtgaaacccccgtctcgacaaaaataaacaaaatcagctgggcatggtggtgcatgcatgtggtctcagctatttgggaggctgaagagagagaattacttgagcctgggaggttgaggctgcagtaagccaagatcgcaccactgtactcctgcctgggcaatagagatagacactgtctaaaaaaaaaaaaaaaaaaaggccaaggtcaggtgaggtggctcatgcctgtaatcctagcactttgagaggccaaggtgggtgggtcacctgaggtcaggagatggaggccagcttggccaacatggtgaaactccatctctactaaaaaaatacaaaaatgagctaggcgtggtggcacgcacctataatcccagctactgaggaggctgaggcaggagaattgcttgaacatggggtgcggaggttgcagtgagccgacatcatgccacttcactccagcctgtgtgacagagcgagactccatctgaaaaacaaaaaacaaaaaacaaactaattaatgaaaacagtaatgttgcaagatataggtcaatatgcaaaaaaaaaatcaattatatttccatataattgcaatggacaggtcaggcacgtttgctcacagctgtaatcccagcactttgggaggccaaggcgggcagatcacttgaggtcaggagttcgagaccagcctggccaacatgatgaaatcccatctctactaataatacaaaaacaaacaaacaaaaaaattagccaggcatggtggtcggcacctgcaatcccaactactagagaggctgaggcaggagaatagcttgaatctgagaggtggaggttgtggtgagccgagaatgcaccattgcactccagcctgggcgacaagagtgacatttcatctcaaaaaaaaaaaaaaaaaaaaaagccgggtgtggtggctcatgcctgtaatcccagaactttgggaggctgaggtgggtggatcacgaggtcaggagatagagaccatcctggccaacatggtgaaaccccgtctctactaaaaatacaaaaaaattagctgggtgtggtggcgcatgcctgtaatcccagctactcaggaggctgaggcaggagaatcgcttgaaccagggagttggaggttgcaatgagctgagatcgtgccactgcactccagcctggtgacagagcgagaccccgtctcaaaaaaaaaaaaaaaaatgcaatgaacaatttctgaaaacgaaattaagaaaacaattccatttacaatagcacccccaaaataaaatacttaagaataaacttaacaaaaggagtacaaaatgtatgctctgaaaccttgaaataattgttgaaacaaatcaaagaagatttgatttctaagtaaatggaaagataccccacattcatggatcagaagatttaatattgttaaattaatctacccaatccctattggaattccagtgacttccttgtagaaattgacaaatgggtcctaaaattcatatggaaactcaggggactcagaatagccaaaacaatcttgaaaaagaaacaagttgaaggctcacacttcccaatttcaaaacttactacaaagctacagtaatcaagacactgtgatactgtcatagggctagacccatagatcaatgatctatagagtccatggctggatgtggtggctcacagctataatcccagcactttgggaggctgaggtgggtggatcacttgaggtcaggagttcgagaccagcctggccaacatggtgaaaccccatctctactaaaaatacaaaaattagccaggtgtggaggtgggcacctgtagtcccagctacatgggaggctgaggcaggagaatcacttgaaccctgagtgacagactctgcctcaaaaaaaaaaaaatctagagtccagaaataaacctatatgtctgtggtcaatttattttaaataagggtgccaagacaattcaatgagggaaagaatagtctttaaataaacagtgctatgtaacagtgaacatgtacaaaacatacacatacaaaataatgaacttgactgggcatggttgctcatgcctgtaatcccagcactttgggagcccgaggtgggtggatcacttgaccccaggagtttgagactagcctgaacaacatagtgaaactcctgtcccacaaaaaatacaaaaagataagcaaggcatggtggtgtgtgcctgtagtcccaactacttaggagactgaggtgggaggatcacctgagcccaagagttcaaggctgcagtgagttgtgatcacaccactgcactccagcctgggcagcagagtaagatcctgtttcaaaaaataataaataaataaggaatgtggagcccctgcctcataccatatacaaaaattaactcaaaatagggttgttgttgttttaaaaccaaatgtaaaagctaaaactataaaactcttagaagaaaacatagggacaagtctttgtagcttcaaatttggcagtgtcttttttttttttttttgagacggagtcttgctctgttgcccaggctggagtgcagcagcacaatctcggttcactgcaagctcggcctcccaggttcacaccattctcctgcctcagcctcccgagtagctgggactacaggcgcccaccaccacacccggctaattttttgtgtatttagtagaaacggggtttcaccatgttagccaggatgttctccatctcctgacgttgtgatccgggtgcctcggcctcccaaagtgctgggattacaggcatgagccaccgcacccatcccggcagtgtcttcttagacatgtcaacaaaaaggaaagcaacaacaatgaaaacagatacattgggcttcatcaaaatgtgaaacttataacatacactggggcctgtcggggggtcgggggagcaagagcattaggataaagctaatgtattcagggcttaatacataagtgatgggttgataggtgcagcaaagcaccatggcacacgtttacctatgtaacaaacctgtacatcctgcacgtgtatcccaggatttaaaataaaatatagaaaatactcaacaatcataataagtgtaaaagaattttggtcgggcgcagtggctcacgcctgtaatcccagcactttgggaggccaaggcaggtggatcacgaggtcaggagatccagaccatcctgactaacacggcaaaaccctgtctctactaaaaatacaaaaataaaataaaataaaataaaaataaataaaaataaaaattagcggggtgtggtggctggtgcctgtagtcccagctactcaggaggctgaggcaggagaatggtgtgaacccaggaggcggagcttgcagtgagccgagatcgtgccactgcattccagactgggggacagagtgagactctgtctcaaaaaaaaaaaaaaaaaaaagaatttgaaacaaaaacgtgaaacttctgtgattcaaagaacaccgtcaagaaagtgaaaaaacgcctgcctgcccgcctttctttctctctctctctctctttctttctttcaacagtctccctctgttgccgaggctggactatactgccgtgatctcggctcgctgcaacctccctgcctcaggctcctgtgattctcctgcctcggcctgccgagtgcctgggattgcaggcatgcgccgccacgcctgactggtttttgtatttttggtggagacggggtttcgccgtgttggccgggctggtctccagctcctgaccttgagtgatctgcccgtctcagcctcctgaggtgctgggattgcagacggagtctcgctcactcaatgctcaatgttgcccaggctggagtgcagtggcgtgatctcggctcgctaaaacctccacctcccagccgcctgccttggcctcctaaagtgctaagattacagcctctgcccggccgccaccccgtctgggaagtgaggagcgcttctgcccggccgccaccccgtctgtgctgggtgtggtggtgggcgcctgtagtcccagctttttggaaggctgaggcaggagaatcgcttgaacccaggaggcggaggttgctgtgagctgagattacaccactgcactccagcctgggcgacagagcaagactccatcttaaaaaaaaaaaaaggccgggcacagtggctcacgcctctaatcccagcactttgggaggacaaggcaggtggatcacgaggtcaggagattgagatcatcctggctaacacgatgaaaccccgtctctactaaaaatacaaaaaattagccgggcctggtggcaggcacctgtagtaccagctacttgggaggctgaggcaggagaatgacgtgaacctgggaggcggagctggaagtgagccaagatcgtgccactgcactccagcctgggcgacaaagcgaaactccatctcagaaaaaaaaaaaaaaaagtaagaaaagaaaaaaagaaatgtaaaatagtaaacagaaatatctcccagctcttaaaattaggcaattctgttggaaaggacataactctgaatagaggttataaggaagagtttggatttaacaggagagtgccaagaagctcttccagtttacaaagcaggagagtatcattaagcctgtgttttagaagatgactgcattctgtgattctgaaatagctatatataggttgctcgtgaaatctgtgctgctagtcttcttttttttttttttgagacagaatcttgctctgtcccccaagctggagtgcagtggcacgatctcagctcactgcaacctccgcttcctgggttcaagcaattctcctgtcttggtctcctgagtagctgggattacaggagtgcaccaccacgcccagctaatttttgtatttttaatagagaaagggtttccctgtgttgaccaggctggtcttaaactcctgacctcaggtgatctgcccgcctcggccttccaaagtgctgggattacaggcgtgagccactgtgcccggcgtcgctagtcttctcttactgaagtgaaactcacctctattctttttttttttctttttctgtttttgagacagagtctcagtctgtcacccaggctggagtgcagtagctcgatctcggctcactgcagccttcacctcctgggttcaagtgattctcctgcctcagcctcccaagtagctgggattataggagtgcatcaccacgcccagataattttttttttgtatttttagtacaggtggggtttcaccatgttggccaggctggttttgaactcctgacctcaaatgatccaccggcctcggcctcccaaagtgctgggattacaggtgtgagccatagtacccagccagaaataaatttattgactgatataaattaaaattcctgtgtatagctggcttcaggaaagcctgaataggtgttcaaagaatgtcatcaggaacttgtctcaccaatcccttacctgtgttagcttcaattaaaaaaacatatttttgggccgggcgcagtggctcacacctgtaatcctagcactttaggaggccgaggtgggtggatcacctgagatcaggagtttgagaccagcctggccaacatgatgaaaccgtctctactaaaaacataaaaattatcgggcgtggtggtgcataaccgggcatggtggtgcatgcctgtaatctcagctactcgggaagccgagggagaattgcttgcatctgggaggcagaggttgcagtgagctgagatcgcaacattgcattccagcctgggcaacaagagtgagactccatctcaaaaaaaaaccaaaaaacaaaaacaaaaaacatttttttaagagacagtttcactctgtcgcccagagctgggtccagtagtgcaatcacagctcactctaacctcaaagtcctggactcaggcattcctcctgtcccagcctcccgagtcactgagactataggcaagcaccagcacgcctggttactttttttttttgaaacagggtctccctctgttgcctatggtggtatgcagtggtgcaatcatggttcattagagcctcaatctccgaggctcgagcaattttcccgtgtcagcctccaaagtagttgggactacaggtaagtgccacaatgtccagctaatttttttttctttttattgagacggagtctcgctctgttgcccaggctggagtgcagtggtgcaatctcggctacaacctccgcctcccgggttcaagcgattctcctgccttagcctccgaagtagctgggactacatgcgcgtgccaccacgcccggctaattttttgtatttttattagagacggggtttcaccgtgttagccaggatggtctcgatctcctgacctcatgatccacctgcctcggcctcccaaagtgctgggattacaggcatgagcctccatgcctggcctgtccagctaatttttaaattttttgttttagggatgaggtcttgctatgttgcccaggctggtcttgaaatcctggcctcaagtgattctcccctggcctcccaaagtgctgggattacagatgtgaaccactgcgcccggctgttagcttcattttcaggcagcctcttctttctgccattttgccgaccagagtcgaaagaaatctcatccctaaaagttcctgcaatggtgcttgggaagaatctcattggtctacagtaggtcataaattcttctgtaaactaatcaccatggggaagaggaggtaaggtatgttctgctcggccagggtaatagcagtgggaacagaggatggactggccaggaaataacatggtggaggcagagtatgcaagtgctcattgcttagcagtgttgggaaagaaagaggattttatctattgaatgccagccatgtgttggccactgtgctgggcaaatgcaactcattttgaaggccagacatggtgtggctcatacctgtaaccccagcactctgggaggctgaagcaggaggatcacttgaggccaggagtttgagaccatcctgggtgacacagtgagatctcatctacaaaaaatgaaaaattagctaggtccagtggctcgtgcctgtgggcccacctcctggggagactgtggcaggaggaggattgcttgagcctgggatgtcaaggctgcaatgaaccataatcacaccactgcaccccagccaaggcgacagagcaagatcctgtctcaaagaaacagacaacaactcagtctgtggaagagggggacatataaacaatgactatccaatgtaccagttacaatgattgaggtatacagcaagggccactaacacaaaacagaaaggaaagcatttgggcagtgactgtgggtcaggggagaggcagttcccagagaaggaaatcttgacttgagttttatttatttattttaatttttatatttttgagatggagtctcactctgtcacccaggctggagtacagtggtgcgatctcggctcgccgagccaccacacctcgccaggtttcaagggataagtaggatacatgaaagtttggtaggaaacaaagagtaagagatttcaggcccaggctgggcacggtggctcacacctgtaatcccagctctttgggaggctgaggcagatagcttgagttcaggagttcgagacaagcctgggcaacatggcaagaccctgtctctaaaaaatatataaattaaaaataaattcaggccaggcgcagtgactcacatctgtaatcccagcacttagggaggccaaggtgggtggatcatttgaggtcaggaggttgagaccagcctgaccaacgtgatgaaattctatctctaccaaaaaattaaaaaattagtcaggtgtgatggtgcatatctgtagtcccaggtacttgggtggctgaggcaggagaatcacttgaaccagggaggtggaggttgcagtgagccgagatggtgccactgcactccagcctgggtgacagagcaagactctgtctcaaaaataaataaataaattaattttaaaaaagagatttcaggcccatgtcaagggcaaagaacagagtcaaaaaagaaaaattgctggccagggcagggcctggtggctcatgcctataatcttagcagtttggtaggctgcggtgggagcatcacttgaggccaggagtttcagaccagcctgggcaacatagcaaatccctgtctctatttctttaaaaaaaaaaaaaaaaatctggccagaaaaaccacatccaaaccaaagacatatttagttttgctcgcacaacatttttagaaatttttgaattagttgccaacattgaaagatctagagctttcacataaaaatccatatttctactttatcttgaaaagccaagtttggctacacagggccagcatttcttcatggtgacaagtggctggcaccaccacagcccctccactccctgttctggttcacccgccctgcctcagatgctcatgttacctgcacagtcctctctagtgaatgaaagacggctgccaatcctttgtaaatttccacatcaaaagaagttggctgggtgtggtggctcacacctttaatcccggcactttgggaggcaaaggtggatggatcacctgagctcaggggtttgagaccagcctggccaatatggtgaaaccccatctgttgccaaaaagagtggtttgtttgtttgtttgtttatttgtgtatagacagggtctcactctattacccaggctggagtgcagtggtgtgatcatagctcactgcagacttgacctcttgggctcaagcgatcctcccacctcagcctcccaagcagctggaactataggcacacgccacctatagtctggctaatttttaaatatttttagagacaagggtcttactttgttgcccaggctggtcttgaactcctggccctaagtgatcctcctgccttggcctcccaaaatgctgggattagaggtgtgagccactgcacccagcccgctaactttttatattattcgttgagttaggatctctctgtgttgcccaggctagtcttgaactcctgggctcaagaaatcctcctgccttggcccctcaaagtgctgggattacaggtgtgagccaccacactggagccattatttattattattttgtttgtttgtttgttttgaaacagggttgcactttgttgcccaggttggagtacagcagtgtgatgttggctcactgcaacctctgcctccctggttcaagcaatcctcccacctcagcctcctgagtagctgggacaacaggtgcatgcccagctaattttgtatattttttgtagacacaaggttgcaccatattgcccaggcagttcttgaacttctgagctcaactgatccacccgccttggcctcccaaagtgctatgattataggtgtgagccactgcacctggccaaattgacaaccattttgttatttctcattattctgggattttgagcagaagcatcctgagaaaggaagcaaaaccttttagtctactgaaaggataggcctgtaattgtcacagaataacttctaccacattctatcagttaagcagtcatgggagctgggtgtggtggctcatgcctgtaatctcagcactttgggaggctgaggtgggcggatcgcctgaggtcaggagtttcagaccagcctggccaacatggtgaaaccccatctctactaaaaatacaaaaattagccagctgtggtggcgtgtgcctgtaaccccagctactcaggaggctgaggcacgagaatcgcttgaacccaagaggtggaggttgcagtgagctgagattgtgccactgcactccagcctgagtgatggaacaagactctgtttcaaataagtaagtgagtaagtaagtaagtaagtaagtaaataaataaataaaagatggatcagaagaaggtgagatggcctgcagattacttagggggttcctgcaatggtagaagcaactcaactcaggtagtgtcggtagtgatgaagagaaaaggggagattcaaggtcaagactcctcactccaggaggccctccctggggttctaatgggacatgcaggtcagaaccaggaaacacagagacaggtttgtacctcagagacaggctgagagtcatcagagtttgcaattgaagctgcctatgtggataagatagtgtggggagtttgagtgcaataagaagagatggaggtgcgggactcacgtctgtaatcccagcactttgggaggctgagatgggtgggttgcttagggccaggagtttaagaccagcctgggcaacattatgggaccccccccgcctctccaaaaaccagaagtattagccaggcatggtgttgcacgcctttagtcccagcactttgggaggctgaggcaggaggatcgcctgagcccaggactttgaggctgcagtgagctgtaattgcacccctgcactccagcctgggtgacagaacaagaccctgaatctaaataagtaactaagaggtggagtcctgggaggactctgggtgtaatgagtaaagcagaggaagagacaccccacaggggattgacagagaaagccatagagaaagatgagaacaaggggagggtgcgtcgtcgcatattcgaaaggaacatgttcaaggaggaggcatagtcagtagcattggatggacaccaaaacgtgtttgcctgatttgatgaccaggaagttactggtggccctgctgagggcaaatcttttttttttttttttttaatggagtttcgctctgtcacccaggctggagtgcaatggctcaatctcggctcactgcaacctctgtctcccgggttcaagcgattctcctgcctcagcctccccagtagctgggattacaggtgtgcgccaccacacccagctaatttttgtgtttttagtagagatggggtttcaccatgttggccagggtggtcttgaactcctgacctcaggtgatctgcctgcctcagcctcccaaagtgttgggataacaggcgtgagccaccgggcctggctggtgagggcaaatatatgtggaatggcgagggcagaagacagactcaagtaggtggaaaagtaggaaatgaggaagtggagacagtgagtgtccaccactctctcaagaaactcacatgtgaacaataggagtgaaatagggaagtggtttgaggttgccaagttgagagaggttccccctgcacacaggaacctgggtgtgttttatatcctgaaaagagagggtctgcagagagaggcctgccagtagaggagaaaagggtgaaacgatgaggtgagatcactgaagaaatgggaggaatgtgtcccaagagggatcggccttgggcccaatgagaaccattactttaaaaacatttttttagagacagggtctccttctgtcatccaggctggaatgcagtggcgcaatcatagttcactgaagcctccaactcctgggctcaagggatcctcctgcttcagcctcccgagtagttaggactacaggcacatgccatcacacgtggctaatattttattttatttatttatttatttatttgagacagagtttcgctcttgctgcccaggctggagtgcaatggtacaatctcagctcattgcaacctccgcctcccgggttcaagcaattctcctgcctcagcctcccaagtagctgggattacaggcatgcgccaccacgcctggctaattttttgtatttagtagagacagagtttcaccatgttggtcaggctgatatcgaactcctgacctcgggtgatccgcccgccttggcctcccaaagtgctgggattacaggcattagccaccgtgtccagcccatattttatattttgtagaaatggagtctcactatgttgttcaggcttgtctcaatctcctggcctcaaatgatcctcctgccttggcctccagaagtgctgggatttcaggcatgagccactgtgcccgggcaggagtgctttcagaatgtgagtcagtgctgaccctgcaggtagatggaagatcagggccacatgaggaggtgccaggctaccagagcaacctcttgccaatgaaactgttacttctttacctggagacttgtgggggctccgtgctactcactggagaaaactccttgagaaggctctgtttgaggtcccccatgctctgcccctatggaccttcccagcattctgacctttcctctcaccccaagcatctgaggccccagccttgggggacagctctccattccctaaaacgtcatgatcttttcctgccttcatctgaatggctcttctccctcctgcctctcttctttgcttggcagactcctattcaatacctagttcaggccaggagcagtggctcacgcctgtaatcccagcactctgggaggtgaggcaggcggatcacctgaggtcaggagtttgagaccagcctgggcagtatagcaagaccccatctctaaaaaaatagaaaaattagacaggtgtggtggcttgcacctggaatcccaacactttggggtgcccaggcgggcggatcacctgaggtccggagttcgagaccagcctggccaacatggtgaaacctgtctctacaaaaaatagaaaaattagacaggtgtggtggctcacacctggagtcccagcactttgagaggccgaggcatgcagatcactctgaggtcaggagttcaagaccagctcagccaacatggcaaaaccccatctctactaaaaatacaaaaattagctgggcatggtggcaggcacctataatcccagctactctggaggtggaggcaggagaattgcttgaacctgcggggaggaggttgcagtgagccgagatcgtgccactgcactccagactgggcgaaacagcaaaactccatatcaaaataaagaaatcatgtctgctatggcagacccacagtcagctgcagctctgagccaactgcaggatgaagaaccattgcctaattggaaagtgtcagcatcccagaattcaaaaaagaaatctgatgaggcttttcctgcttgatatattatatggagaatttagatcttatgttggtttgcacaagttccctgcagaaaaaaaaattgctctgtgtatatctcttggaaaataagataatactatttttcctttgcaaaggcagctataacagatgtgaagactcagtgctcggtggtgcccaggctggagtgcagtggcgtggtctcggctcgctacaaccccgtctgggaagtgaggagcgtctctgcctggccacccatcgtctgggatgtggggagcccctctgcctggctgcccagtctgggaggtgaggagcgtctccgaccggccgccatcccatctaggaggtgaggagcgcctctttccggccgccatcacatctaggaagtgaggagcgtctctgcccggccgcccatcgtctgagatgtggggagaacctctgccccgccgccccgtctgggatgtgaggagcacctctgcccggccacgaccccgtctgggaggtgaggagcatctctgccccgccgccccgtctgagaagtgaggagaccctctgcccggcaaccaccccgtctgagaagtgaggagaccctccacccggcagccgccccgtctgagaaatgaggagcctctccgcccagcagccaccccgtctgggaagtgaggagcgtctccgcccggcagccaccccgtccgggagggaggtggggggggtcagccccccgccaggccagcagccccatccgggagggaggtgggggggtcagccccacgccccgccagccgccccgtcagggagggaggtgggggggtcagccccccgccaggccagccgccccgtccgggagggaggtcggggcgtcagcctcccgcctggccagccgccccgtccgggaggtgaggggcgcctctgcctggtcacccctactgggaagtgaggagcccctctgcccggccagcggccccgtccgggagggaggtgggggggtcagccccccacccggccagccgccccgtccgggagggaggtgggggggggtcagccccccgcccggccagcggccccgtccgggagggaggtggggggggtcagccccccgcccggccagccgcccggtccgggagggaggtggggggggtcagccccccgcccggccagccgccccgtcccggagggaggtgggggggtcagccccccgcccggccagccgccccgtccgggagggaggtaggcgggtcagccccccgcccggccagccgccccgtcagggagggaggtggggggttcagccccccgccaggccagccgcccggtccgggagggaggtcggggcgtcagccccccgctcggccagccgccccgtccgggaggtgaggggcgcctctgcccggccgcccctactgggaagtggggagcccctctgccaggccagccgccccgtccgggagggaggtggcggggtcagccccccgcccggccagccgccccgtccgggagggaggtgggggggtcagccccccgcccggccagccgccccgtccgggaggtgacgggcgcctctgcccggccgcccctactgggaagtaaggagcccctctgccaggccagccgccccgtccgggagggaggtggcggggtcagccccccgcccggccagccgccccgtccgggagggaggtgggggggtcagccccccgcccggccagccgccccgtctgggaggtgaggggcgcctctgcctggccacccctactgggaagtgaggagcccctctgccaggccagccgccccatccgggagggaggtgggggggtcggccccccgccgggccagccgccccgtccgggagggaggtgggggggtcagccccccgcccggccagccgccccgtccgggaggtgacgggcgcctctgcccggccgcccctactgggaagtaaggagcccctctgccaggccagccgccccgtccgggagggaggtggcggggtcagccccccgcccggccagccgccccgtccgggagggaggttggggggtcagcccccgcccggccagcggccccgcccgggaggtgaggggcgcctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgtactaagaaaacttctgccttgggatcctgttgatctgtgaccttacccccaaccctgtgctctctgaaacatgtgctgtgtccactcagggttaaacggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcctatgaccctgccaaatccccctctgtgagaaacacccaagaattatcaataaaaaataaataaattaaaaaaaaaaaaaaaacagatgtgaaaataaatacactcaactctaatatgattatacagaagagcatgaatgcatttcaaatgttagatgttgctagtattatcaaatgatttatttttcttttcttttcttcttttcttttcttttttttttttttttgaaacagggtctctctgtcaccgaggctggggtgcagtgacacaatcatggcctaatgcaacctcgacctgctgagcttaagcaatcctcccacctcacccgcccccagagtggctgggactgcaggcacgtgccactgtgcccagttatttattttttccttttaaattttttgtagagacaaggtcctactacgttacccaggctggtctcaaactcctggactcaagcaatcctcccacctcggccttccgaagtgctaggattatgggcctgagtcaccacactcagcctcaaataatttcatattgaccttttaatcattattcctctctgccaagcactgaaaagttgaatcattatactctatttctgcagtgatatagattatgaaaattcctttcgaattcattgcagcagctaacttttttgagtcattgacttcattttatattttaaaaattatgaaataccgtctgtcattgcattctaattaaaatttgtgcagaatgctttgggaaaatggatcttttatagaaaaaaaactggaacaaatgatttcttttctttcttttttttgttttttgagatggggtcttgctctgttgcccaggctggagtgcagtggcatgatctcggctcactgcaacctccgcctcccgtgttcaagcaattctctgcttcagcctccacagtagctaggactacaggtgcccactaccatacccggctaatttttgtatttttagtagagatggggtttcaccatattagccaagctggtcttgaactcctgaccttttgatccacccaccttggcctcccaaagtgctgagattacaggcgtgagccaccacgctcggcctgggacaaatgatttctatggctttcaaagataaaatatataatatactaaatcaggggtgtccaatcttttggcttccccggaccacattggaagaagaattgtcttgggccacacataaaatatactaacgatagctaatgggctaaaaaaaaaaaatcacaaaaaaatctcataatgttttaagtttaccaatttgtgttggtctgcattcaaagccatcctggatcatcctggggttgcacaagcttgcactaaaccaactctaacatagcttattctgttttactgttaaattatatctctgggctgggcaaggtggcgcatgcctgtaatcccagcactttggaaggccaaggtgggcagatcacttgaggccaggagtttgagaccagcctggacaacatggcgaaaccccatctctactaaaaatagaaaaattggctgggcacggtggctcatgcctgtaatcccagcactctgggaggccgaggcaggcagatcatgaagtcaggagttcaagaccagcctggtcaacatggtgaaaccccatctctactaaaaatacaaaaaattagccaggtgtgggccggttgcggtggctcacacctgtaatcccagcactttgggaggccgaggcaggaggatcacaaggtcaggagatcgagaccaacctggctaacacggtgaaaccccgtgtctactaaaaatacaaaaaattagctgggtgcggtggtgggtgcctgtagtcccagctactcgggaggctgaggcaggagaatggcgtgaacctgaaagacggagcttgcagtgatcacaccactgcactccagcctgggcgacagagcgagactctgtctcaaaaaaaaaaaaaaaaaaaattagctgggtgtggtggcacacacctgtaatcccagctactccggaggctgaggcaggagaattgtttgaacccagaaggcggaggctgcagttagctgagatcatgccactgcactccagactgggcgatagagcaagactctgttttgaaaaaaaataaattagccaggagggttggtgcactcctatagtccctgctacgtgggaggctgaggcatgagaattgcttgaacccaggaagtggaggctgtagcaaactgagattgtgccactgcactccagcctgggcaacagagcgacaacccgtctgcgaaaaaaaaaaaaaaaaaaaagcttttatggatgattaaattttagtacatttccaaaaaaaaaattcttgctaaatttaggtgtaattaattatgtattacgtaatggtactgtggttaggtaaagtaatccttatctgacatacaataatatgacgaatctcaaaacattatgaaaagtgaaaaaaagcagacccgtattgtatatttcatttgtgtggaacattctagaacaggcaaaattaatctataatgacagcaaaaagatcaatcgctgtctggggctgaggttggggattgattggggaaggaacttattttttttatttttattttttttgagatggagtctcgctctgtcgcccaggctggaatgcagtggcgcgatcttggctcactgcaacgtccgcctcctgggttcaagcgattctcctgcctcagcctcctgagtagctgggaccacaggtacttgccaccacgcccggctaattttttgtatttttagtagagatggggtttcaccgtgttggccagaatagtctcaatctcctgactggcagccactgcgcctggcgagtggaaggaaattttaagggtgatgggagtatttcatattttgattatggtagtaattacatgggtatgtatatttgtcaaaactaactgaatcatgcacttaaaatgaatgtgctttattgtatgaaaattaaagtgggctgcgcgcagaggctcacgcctgtaatcctagcactttgggagcctgaggcgggtggatcacgaggtcaggagtttgagaccagtgtggccacatagtgaaaccctgtctcaactaaaaatacaaaaaattagccggctgtggtggtgtgcacctgtaatcctagctacgtgggaggctgaggtaggagaatcacgtgaacccgggaggcggaggtttcagtaagctgagatcgcactactgcactccagcctgggtgacagcgtgagactccgtctcaaaaaaaaaaaaaaaaaaaaaaaaaaagataaaaaaagaaaattaaagtgtgttttgttgtatgtaaataaagtttgttttaaaaagaaggaaaataacgttacaactagaataaaaataatccgccaggcatggtggtgcacacctgtaatcctagcactttgggaggccaaggtgggaggatcgcttgagcccaggaattcaagaccagtcttggcaaaatggtgaaaccctgtctctacagaaaatgcaaaaattagccagttgtggtgatgagcacctgtcccagctacttgggaggctgaggcaggagacttgcttgaacccaggaggaagaggttgcagtgagctgagatctcgtcactgcactggaattacaggcacacgccaccacgtccagctaatttttgtatttttgtagagacgggtttttgtgatgttggccaggctggtctcaaacttctgacctcaggtgatctgcccaccttgaccctgaaaagtgctgggattacaggtttgagccactgcatctggccagatctaagagatttttttttaagtctctgtgtgttagaggtaaatactgaagttttttttttttgtttttttgagatggagtctcactgtgtcgccagtctggagtgcagtggcatgatcttagctcactgcaacctccacctcctgtgttcaggcgattctcctgcctcagcctcccgagtagctgagactacaggtgtgcaccaccacgcccagctaatttttctgtttttagtagagatggggtttcaccatgttggccaggatggtctcaatctcttgacctagtgatctgcccacctcagcctcccaaagtgctgggattacaggtgtgagccactgtgcctggctaatactgaagtatttaagttgaaatgctatgatgtctgagatttgttttaatacattctgtttttttttgttttgttttgttttgagacggagtctcaatctgtcgcccaggctggagtgcagtggcgcaatctcagctcactgcaagctctgcctcccgagttcacgccattctcctgcctcagcctcccgagaagctgggactacaggcgcccaccacctcgcctggctaattttttgtatttttagtagaaacagggtttcaccatgttagccaggacggtctcgatctcctgaccttgtgatccgcccgcctcagcctcccaaagtgctgggattacaggcgtgagccactgcgcccggctgttttaatacactctaagaaaataatgtgaaaaaagaaatgaatcaatgtttgctaatattgccatatttgaatcaaatattgccaatatatgttgaccattgtcaaagctggatgatgggtacaaaagagtttattatacaattattcccgttttctgtatttgaaaatgtctacaggccgggcatggtggcacatgcctgtaatcccagcactttgggagcctgaggcaggaggatcacttgaggtcaggagttggagaccagcctggccaacatggtgaaaccccatcactactacagatacaaaattagctgggtgtggtggtgcatgcctgtaattccagctactcaggaggctgaggcaggagaatcatttgaacccaggaggtgaaggttgcagtaagctgagattgcagcattgcactccagactgggcaacagaatgagactctgtctcaaaaaaaattggctgcatgaggtggctcatgccagtagtcccggcactttaggagcccaaggtagaggattgcttgagcctaggaggtcgagtccacagtgagctctaatcgagccactgcactccagcctgggtgatagagtgagaccctgattcaaaaaataaaaataaagttaacaaattcttgaaaacagataaaataggctgggcgcagtggctcacgcctgtaatcctagcattttgggaggccagggcaggcagatcacctgaggtcaggagtttgagaccagcctggccaacatggtgaagccccatctccactaaaaatagaaacaaattagctgggcatggtggtgaacatctgtaatcccagctactcaggaggctgaggcaggagagtcgcctcaacctgggaggcagaggttggagtgaaccaagattgtgccattgcactcctgcctgaacaacagagtgaaactccatctcaaaaataataataataataataataagagataaatccttattaccatcaaaagttaaaaaagaagaaagaagggccgggagcagtggctcacgcctgtaatcccagcattttgggaggccgaggcggacggatcatgaggtcaggagatcaagaccatcctggctaacagggtgaaaccccgtctctactaaaaatacaaaaaaattagccgggtatggtggcgagcacctgtagtcccagctacttgggaggctgaggcaggagaatggcgtgaacccaggaggtggagcttgcagtgagctgagatggcaccactgcactccagcctgggcaacagagcgagactctgtctcaaaaaaaaaaaagaagaagaagaagaaggaaacctagttcaaattttgataaggaaaaaaaaaaagagagaatttgttgcttcacataatggaaaggatctagcttcaagtgcggctggacccagggcgggctccgggagtctgtcttgttctctccctttcttgaccctactgtcctctaggttggttctgttctcaggcagttttgcttcagatgaaggtgggatgactaccagcatttcttagacttctatcctataatgtgagtcatccaacagaaagttccaataaaaggcctgcaattagcactttgggaggccgaggtgggcggatcacctgaggtcaggagtcccaaaccagcctgaccaacatggtgaaaccccgtctctactaaaaaaatatggaagtagccaggcttggtggtgcatgcctgtaatcccagctcctcaggaggctgaggcaaggagaatcgcttgaacctggaaggtggaagttgcagtgagccgtgattgcgccattgcactccagcctgagcaacaagagcaaaactctgtctcaaaaaaaaaaaaaaaaaaaaaggcctggaattagttcgcagggcactgttggcctggcctgggtctccagcgctcatcactcctctcttaatcagctgttctctaatggcaggagtgtgctaattagcctctgaatccccagcacaaagcaccctgcctgggacacaagtaggtgggtggatggatggacagatgggtgaggaagaggatagaaaataagcaacacagtgagaccatgtctctaaaaaaattaaaagagggctgggtgaggtggctcaggcctataatcccagcactttgggaaaagctgaagcgggagaattgcttgcattcaggagttcaagaccaacctgggcaataatgcaaaacccccatctccacaaaaaatttaaaaattagctgggtattatggcacttgcctgtagtcccagtgactcgagaggctgaggtgggaggatcgctcacttgagcctgggaggtggaggctgcagtgagctgtgattgtgccactgcacgccagcctgggcgacagagtgagacgctgtctcaaaaataaattaattaaattaaataaaaaataagaaaaagagctgggcacggtggctcacgcctgtaatttcagcactttggtaggccaagatgagcagatcgcctgaggtcaggagtttgagaccagcctggacaacatggtgaaatcccatgtctactaaaaattcaaaaaatttggccgggcgtggtggctcacgcctgtaatcccagcactttgggaggccgaggcgggtggatcatgaggtcaggagatcgagaccatcttggctaacacagtgaaaccccgtctctactaaaaatacaaaaaattagccgggagcggtggcaggctcctgtagtcccagctacttgagaggctgaggcaggagaatggcgtgaacccaggaggcggagcttgcagtgagccgagatcgcgccactgcactccagcctgggcgacagagccagacgctgtctcaaaaaaaaaaaaaaaaaaaaaaaaaaaaaaattcaaaaaattagccgggcgtggtggcgggcacctgtaatccctgctacttgggagcctgaggcaggagaatcgcttgaacctgggaggtggaggttgcagtgagccaaggtcgggttactgcactccagcctgggcgacagtgtaagactctgtctcaaaaaaaataaaaaataaaaaataagaaaaataagaaaagggtccctttcacatgtttacaaagcatgctaccatgctaagggcagaaactccaagtggaagtgacttcccaaagacagcatgttacgtgtgtcattctagggccacactttctccatggagaaggcggagggggtagggaaagttgccagcacactccagcctggttcctggcactgtgcccagcatttatagctagtttccattagtcctcatcctctataaagtgagggccactgtgcacctgtcctagatgaggaaaacgcacctggccagggacagtaaggagatgctgaaaccaaggttatcaggggtgcctgaccccaccatgctccacagcctcctttgggcaagacagactagggaagctctgtgaaccttgctaaagacattggactttggccgggcatggtggttcacgcttgtaatcccagcactttgggaggcccaggtgggtagatcacctgaggtcagaagttcaagaccagcctggccaacatggtgaaaccccctctctactaaaaatacaaaaatttgccaggcaaggtggcatgcaccgtaatcccagctactcgggaggctgagtcaggagaatcgcttgaacctaggaggcgcaggtcacagtgagcagagattgtaccactgtactcaagcctgggtgacagtgagactctgtctcaaaaaaaaaaaaaataaataaataataaaaataaaaagaggagtaatgatttgattccaacacttcagtctacctctactgtaggtatctggctccttggaagggcctctggtcctgtctccctccagggtaggtgtaatcagaactttttcagctgcaagtgccaggaatccaactcatacttcttggcttacgtgaaaaagaagtgcattgccttatacaacaggaaagttaagggtttcaggcacagcttgatccagacactcaaatgatctcaagaatatgtctcttcatatctggcctcttcaggcctctgtgtagacccatcctagccagctttttgctgttttttttgtttttgttttttgtttttttttttttgagacagagtcttgctctgtcgtccaggctggcgtgatctcgggttaccaaaactcccacctcctcagttcaaactattctcctgcctcagcttcccaagcaactgagactacaggtgcacaccaccatgcctggctactttttatatttttagtggagacaggttttgccatgttggccaggctggtctcaaactcctggcctcaggtgatctgcctgcctcggcctcccaaagtgctgggattacaggcgtgagccactgcaccttgctctgaccagcttttcctgcataccaacaagatatcaccagcagtgctgggcttacatcctatcagcttcctaactcccagtggagagagggcatctttttcacagcagctccaaggtgagtcttgggcacaagatgaatcaagtgcccatccctgagccaatgaaaacaggttgctttggttgggaagcacaggccatgtgaatacgccaggtcccctcctgaacctcatggagtgcctgtgaggagaggttggttccccaaaagaaaatccaataaagaggcgacgggaccaggcacggtggctcatgcctgtaattgcaccactttgggaggctgaggcaggaggattgcttgagcccaggaggtcgagacccacctaggccacatagtgagatcccgtctctaccaacaatttaaaaaattagctaggtgtgttgggcatgtgcctctggtcccaggtactcgggaggctctgaggatggatgggaggatcgcttgagcgtgggaggttgaggctgcagtgagctgtgatcgtgccattgcaccccagccagagggagaccctgtctcaaaaaaaaaaaaaaaaaaaaaaagagagaggcaatggtaagagctaaaccagcaggaacaagagaggcaaaggtcccccttttttttcttttaattgaaactgggtctccctctgtcacccaggctggagtgcagtggtgcaatcatagctcactgttagcctggaactcctgggctcaagcgaacctcccacttcagcctcctaagcagctgagaacacaggcacatgccaccacagctggctaatttcattttttttttttttaagagatggggtcttgctatgctgcccacactggtctcaaactcctaggctcaagtgattctcgccgctcctgggcaaatgccctctgacatcccttataaggacaccctttgaaaaggttgtccccctctcaaacatggagagccttgccagggccttccccactcactgctgtaactaattcttatgctgcatggacatctgcttcccagaacctccacccaccagccttgcccctgacctttgtggcagccccaaggctgcccaccccttcccctgctgcagcccacttggcctctgaaagcagcactgtctgcctgcaccttgccctctccagggccgtcaggctcgccaccttcaggagcctagttttcaggtccttcaccaatgccctcgtcctgtgggtggacatgaggccctccagagctgaaggcagtgtgtgcttcagtttctgcatctgtaaaatggagatagtatttgctacccaggggtgctatgaggattacatgaacatagtatagtgtctagaacagtgcccagcacatagtaggcactcaataaaagccagttattattcctgtcacttctgtgggagacggcacatcagagtacccaccttatctcggtctagtcccgtccagtcgcaggcctttgagtacagtacagccctaaggtttttacaattgaataatctataaaagatttacagatttattgtctcatttgagcctagtaacttttttgttgttgttgagatggagtcttactctgttgcccaggctggagtgcaatggcacagtcttggctcactgcaacctctgcctcctgggttcaggcgattcttctgcctcagcctcccgagtagctgggactacaggcgcacaccaccatgcccagctaatttttttttttttgagacggagtttcactcttgttgcccaggctggagtgcaatagtgccatctcagctcactgcaacctccgcctcccaggttcaagcaattctcctgcctcagcctccagagtagttgggattacaagcatgcaccaccatgcccgggtaatttttttttttttttttttttgagatggagtctcgctctgtcacccaggctggagtgtagtgccacgatctcggctcactgcaacctccgcctcctgggttcacaccattctcctgcctcagcctcccaagtagctgggactacaggcgcctgccaccatgcctggctaattttttgtatttttagtagagagggggtttcaccatgttagccaggatggtctccatctcctgacctcgtgatctgcccgccttggcctcccaaagtgctgggattacaggcgtgaggcactgcgcccggccagagcctcataactttgtgaggtgggcagttcaaatcttattaattccccatttaccaatgacaaaatgaggttcagagagattagccctcttggccaagatcgcacagccagtcagtggcagaggtgggacttgaacccgtcccttgctgttccttgaacttctccacacgacagggctgtccctcagcctacaggtcacccctctagccttgcctgttggctcttcctaatcctttcaggcccagcccagatactttttaaacaagaatgatgagagctaactttttttaaaatgagacggtcttgctctttcacccagagaagactgggtgataacagtggctcaatcttggctcactgcagcctctgcctccagggttcaagctattctcatgccttagcctcctcagtagctgggattacaggggtgcatcactacaccacgctaatttttgtatttttagtagagatgcggttttaccatgttggccaggctggtctcgaactcctgacctcaggtgatccgccagccttggcctcccaaagtgctgggattacaggcgtgagtcactacgcatggctgagagctaacgtttattaagcacccgccactttctagatgaggtccttactgacttccttgggttattttaggtaatcatccccatacctcttacgtggcaggtatgactgttacagagggagaaaccgaggctgagaaaggctaagtagcggccacacctcactcagcaggtgacaggctgcggtcgcactcatgacatagtctgactctagagcaggcctttcctgcccgctgttgctgcctccagaagcctctctgaatccaagggtgggaactattcctccttgccctcgagccttcgccaaagccagggcttggagcggccgtgggctcctcctccttcccccaggctgggctcttcaggggcggaaacctgcctggcttgcctgccttgctcgaccctgtagcccctggcacgaagtaggtgcccgtgatgccggattatttcagcaggagggcaggggtgttcccgatgaagccaggagatccagggaggagaagcgactcccggggccacccatgcttagatctcagagccaggcaagagccaggtcccgggggtccaggagcgcgctcggggctcctcctcgcccgcgccccccgcgcccctcgcgccccccgcgccccccgcgccccctgcgctcgcgtctgcggggccgggaggaaggggcggcgcagccgggccggggcgggcaccgaggcctggcgggcgggcctggggcgctttcgtgcctgccagggaaaggctggcgaggaggctgggggcggacgcagggaggaaagaagcaatggggtgctcttgcgttttgacattttaaaaagaagtttagattcgcttcccggagccgggatggcagcctgcgctatggttggggaccaacgtggtgcacgggcaggggccggggagagaggcggccgcagcgggagcccgggagcgcagggcgggcctggaagagctccgccccaaggggcgcggccaccccggaggcgggcgcacggctgcttctcattcattgtcttgacaagagcatcttcagcgggcgagtccccggctcctccagctccttcctcctcttcctcctcctcctccacctccggcttttgggggatcactgtcctctctcggcagcaggtgaggctgggcctgggaggcgcgggtgggccggggcgagggccacctgtggggcggcgcgcgcgtgggagccgcgggctgcgggggcgcgcggctgtcaccgcgacccagccagcgccggggccaggtagcgggcgcagcagcccgtggggggacgctgcttggagtgggggccgccggggccccagagcgctctgcggaggcgagggctagggaccaccgcggccaagatggaggtgggtggccgggggtcagcacagtgtcgagggcccgactccccacggaattgagtctcggggagggtggggacgagggcagggtggggtgagcggggcagctgccctgggcttggagacaggaaggggttgagagcaaaacaagaaaagaccaagttcccctttccgtggtttccgggcctggtacctgtggtgggggaggaggcagggtggggcgatggcttcctgtcccccacctctggtccggggctcccctctctccagatacaggctgctcctcaagactggggctcttcacatacgctcctcaccgctctttgggcaggccgacctagcagcctcttcgggagtcctggggtggccgggggtgctggagcccccagtgagtaggcgaggctgaggctaggggcagaggctctgggcatggcaccctccaagcggcagcacaggccccttccctgagcaggaaggtgatgcggtggcacaaggtcgcccctggagttccttgctccccacccagacactgggggaaaccatcctacctggacctcagagcagtcggagtggcctctcccttcctgtgtgcagtttacatgggggtggagatggctcttaagggcacctgcttttctgagcggaggcgagaggcagaggtatggggaggaggagatacctggacctgagccagagacctgctggggaagctatcctgccgcctcactcccctcaggcagcccccacgccacttcctcctgtgtccagccccatgccagcaggcgagggaggccagctcctgtccctgcctttaggaagcgctgtgtgggtgtgagggaggtgggctctggacacggtaactaagagagaacccaccctcggagccatctgggctgatgacgcctgagtctgaaccattaggaaggacgggctctgcatccatcagccagtcagtcaacaaacatgcagtggggcaacaccacgccaggctctgttgcagaggctgagggtacagattgagagggtggctcagagtggcctggggccagggagaagggggcttgcaggttagagggaaggagaggctggggaaggcaagcaggcatcagccacagagggaagaatagggagcccctggagatgatgctgggaccttaaaagccagactgaggggtgtcctgggggaggtggggaccactggaagatcagagttgacctgaagggagaaatgctcttatgctgtgtgcccccagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaaggtgagcccctggggccctggggggagcagctcctccaccggacccatggctctgtgcaggtcctgattaggtgacggtcaccaggccttccagggcctgtgttgccatctggaaaactgagctgggccccatgagccttacacttcctccagctcctctgtgctgtggctgtgtggaaactgacgctcagaaggagccaacacaagatgggtcacaccagtgaccaggactacagacagtcctgcagacccatgatcagccctcctgagcctcagcctggggctttctccccatggaaacacagagggggttgggatggggtctgggggccctggcagcgttctcagggttgggagggactctggctctgggcctgtctgaggacctagcaactctgtcccccagctcgcaggcagggatgatgcaagaggtgctctcccccacccgcagccctgccctcccctggagcctgctgccccctccgctggctggctgctgccccgcacccccagcacactcctgtgctctttggggggtaagacaggaaggggagatgggccccaagttgttaccttaaaagggctgatggaagcaaagagaagaggaagtggttgtcggggtgagagctgggcccgcgccccacatggctgtcacacaggaagccctgctgaagcagctgtccccggaagaagccatttccaaacctctgctcctgcctggggccagttgggacaggctccctggcccctctccttttgggaggacccacccctgcagccccaccactcacactcgctctctggggagctgcctccacccccccagcccccatacacctgtcctggctccagggccagttgtgcccatggaagcctcactcggggaagctggggtgggggtgccaaccctaagggcagagacagactgagacagagaccggcgggaactctgccagggtcttgcacggcccccaacctctgccatgcgtggccagccctcctggggtttgcccaggccattttgggactggaacaagagaagaacaacccgcccccgtccccaccccaggccctggtccagctcccagggacaccacagctttcctctctgggcctctctgaaggaggtgtggggaggttggattgggtttgggaggcaaaagcacctccaaggccctgctgtgcctttagactggacgtgtggacaagaatgcgcccacggtctgtggccacacagcccctgtgctagacatcgcctggtgcccgcacaatgacaacgtcattgccagtggctccgaggactgcacagtcatggtgagtggtggtggggacccaggggctgggagaggggctctaggatgggatctgacatttggagtcctgaagactcactggcccctcctctgcaggtgtgggagatcccagatgggggcctgatgctgcccctgcgggagcccgtcgtcaccctggagggccacaccaagcgtgtgggcattgtggcctggcacaccacagcccagaacgtgctgctcagtgcaggtgctgcgggaggaggggcttgggggtggctcgtggcctgcagtggatgagggcaggaggctcatggcttctgacactgtggggaacgtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgtgagtcgccatctaccctgacctttgaccctacagcctttatccttcttatccaccatcagccaggcccttggatgctgccctccctcgcctccacctgggactggccccgtagggtatgtacgggtgcctgacctaccacctccctttccttgcaggagaaggaccgtccccacgaggggacccggcccgtgcgtgcagtgttcgtgtcggaggggaagatcctgaccacgggcttcagccgcatgagtgagcggcaggtggcgctgtgggacacagtgagtgctggggcaggaagccgagggcccccaggctgggaaccaagactggaggtttcgtccctgctctgccactcacctggcaggatggccatgggcctcagtttacccaggcgtgagatggttgttcccactggttggtcgggagggccctcacaggtcactgcccagggaagaccaccatcccagggcctgggatgttacctctcacctgtgtctacagaagcacctggaggagccgctgtccctgcaggagctggacaccagcagcggtgtcctgctgcccttctttgaccctgacaccaacatcgtctacctctgtggcaaggtggcctcgtcgggcggggtgggggtgggaggtgggcaggatgggcctggagagggccagggcagtgggcatccgctggtattgaccctccctccacacctgccacctacagggtgacagctcaatccggtactttgagatcacttccgaggcccct

SEQ ID NO: 490 - DNA, 546309 bp, Homo sapiens
taaactctgtgcgtaatttcactattttcttgtttaactttatgactgtcctggagagggcagcatcattacctttaatttagagctgggacagggacagtctgtgacacttatcttgatattgaggaatggagtcagtcctccaatggagggaggccgattgaggtgtgatactgagtgccccatcagttgttcaagggctggggcagatctaatattgtgtctgtactggctgatacttaggtggccagggccccagctttggaaacctgtgatggctgctaccacctctggctttgctaggcgcacacatctgcccagactcaatgtattgcaaacccatgcaacctccaggcccacactgagaatcaagaattgtggactcttgattctccaaatcttctcaaaagcccagctgctggctgggtacagtggctcacatctgtaatcccagcactttgggaggacgaggcgggcggatcacttgaggttaggagttcaagatcagcatggccaatgtggtgaaaccccatgtctactaaaaatacaaaaattacctgggcatggtggcaggcacctgtagttccagctacttgggaggctgaggcaggagaatcgcttgaacccgggagacggaggttgcagtgagccgagatcgtaccactgcactccagccttggtgacagggcgagactctctctcaaggcttgagggctgagtgaacactccttaactatttccagttatagccacgggtcgacttagatcaacagaagtctgtatggattactctaatagagtgcaaaaagatctgaactaggacctcattgtgaattcggatcctaccccttaccagctgtgtgaccgtgggcaagacacagaatctctgagctgtcactgccctctctgtaagtgaagtggcacccacttcttatgtctgtgttggtcctcttctcctaattgacactcactcgtttttcgttgttttttttttgagacggagtgtcgctctgtcgcccagactggagtgcagtggcacgatcttggctcactgcaagctccgcctcctgggttcatgcaattctcctgcctcagcctcctgagtagctgggactacaggcgctcgccaccacgcctggctaatttttcgtatttttagtagagacggggtttcaccgtgttagccaggatggtctcgatctcccgacctcgtgatctgcccgcctcagcctcccaaagtgctgggattacaggcgtgagccatggcgcctggccactcttttttttttttttttttttaactttgagatagaatcttgttctgtcacccaggttgaagtgcagtggcataatcctatctcactccaaactcaaactcctgggttacagcaatcctcccacttcagcctcccaagtagctgggaccacaggcacatgcccccctgcctggctaatttttaaaattttaagtagagatagggtctcaccgtgttgcctaggctggtctcaaactcctgggctcaagtgatcctcccaccttggcctccaaaagtgttagggttacaggcatgagccatggtgcctggtgacactcactcttgagttgagctcacacagacccctggctttaaatatcatccaaatgttgatgtcccccaagttttcatcttcactgcagacctcttctgtgagcttcagaactgctcacttgaaacttccccttgggtgtctgacaggcaacacaaacttaacatgtcccaacatgaactttttttttttgagacagaatcttgctctgttgcccaggctggagtgcagtggcctgatcttggctcactgcaaactccgcctcccaggttcaagtgattctcctgcctcagcctcccgagtagctgagattacaggcacgtgccaccacacccggcaaattttttgtatttttagtacagacagggtttcaccctgttggccaagctggtttcaaactcctgagctcaagcgatctgcctgcctctgcctcccaaagtggtaggattacaagtgtgagccaccgtgcccgggcccaaaatgaactctttatcttctcccccatacctgctcctcctgcagccttcccatatcagaatacaacaattctattcttacagttggtgtggccgaaaaccttggtgttgtcctcaatcctctctcacacatccccaaatccaatctgtcaagaaaccctggtgatcacttgagcccaggagtttgagaccaacctgggcagcatagcaagaccctgtctctacaaaaaatacaaaaatcagcggcagggcgcagtggcttacgcctgtaatcccagcactttgggaggctgaggcaggcagatcacaaggtcaagagatcaagacaatcctggccaacatggtgaaaccccgtctctactaaaaatacaaaaattagctgggcatggtggcacgtgcctgtagtctcagctacttgggaggctgaagcaggagaattgcttgaaccagggaggcagaggttgcagtgagccaagatcgtgccactaccctccagcctggtgacagagcaagactctgtatcaaaaaaaaaaaaaaaaaaaaaaaaaaaagctgggcatgatggcacacacctgtggtcccagccactcaggaggctaaggtgggagggtcgcttcagcccagaagttggaggccgcagtgagccataattgcaccagtgtactccagtctgggccacagaataaaactctgtctctagaaaacagaacaaaacaaagttgaagctctctaaactctccacactgactcagagtgaaagtgctaataatgacctaaagccgtgccctatggccccctttcctcttgacttcgcttttcatgcactctgctccagccatactggcctccttgggcttcccagaacacgcgaagcaggacccaggttagggcctttgaactggctttgtttgtccgtgggattccccatgaacatctcatggctgctccctctcttccctcaagtctcccctcagatgtccccttctcagagacatcagcctgtagaaaggagcacttccttcccccactttcctgcgtgatgtttctccatgatgcctgcttcctacatatgtagagtctgtctcactccggagaaggctacctccaagaggacaggtgactggcccttgatttcattaattgtcacaatcctatgccggacacatggttggtgttcaacaaatatttgcggaattaaagaacaaattaataatgttgtgagataaatactctgtgcccatttttctttactttttaatatattttttaaatctagagagacagggtctccctatggtccccaggatggcctcaaaactcctcctgccttggcctccttggctgggattactggactactactgtgccaccatgcctggctcttcttttccttttactatgcccattttaaaggtgaggaaaactgagactcagaaatgttcccaagggcacacagtgagtggtggctgccttcaggttggtctgactccagtgcccaagcctttctcaggagtggtgtgttgcccatcagccattatatccatgacatcaactggcataagatatgttcttatatgaaaattaattttagaagtgagtgtcacgaaatattgaccttctctaaggaactagttcttatagtcaaaaaggaggaacttatgtaaattttccctttcagggccagccccaggaagttcagagcctaatgtggtgttcattctattaattttttcttaccctgggacttttttctttctttcatttatgttaacctaatcaccagctgcttcctgttccttaggaaatagctaagtcgtacatgacacttttggggttccagtgtgcccggcatgggttttctttcattgggcaggcactaggtgggcttttcagcctgaagacgcatgtttctcatcagagtgagaatgatctctgatcattctccttcttccatttcttgggttctctcttcctggcactcctattggttagcttttgggcctcttggattgcctggctgtgtctctgtggcaaagactactcattatccaaaatccaatgagcccttcttccccaagaacatggtggaactgcatgtcccagcctcccttgcagtaggcatggtcatgtgactaagtttccaccaatagaatgtgaggaggtgatgtatgtgacttctggtctttggccttaggaagtaggccagcttcatactctccattcctgctggctggagatccccacaacagattcaaacgtgcaggtgacaaacggtgccctaccgatggcagaaaagtgatgaggaagggcccttggtccctgagcaatgagagaagcagagctgcctccctaactaccaccatttcacttgaacatgtctcttcttttgtttatttatttatttgttttttgcagacacgtctcttcttttttttttttgagatagagtctcactctgtcccaggctggagtgctgtggcacaatctcggctcactgcaacctctgccttctgggttcaagtgattctcctgcttcagcctcccaagtagctgggattacaggcatgcgccaccatgcctggctaatttttgtatttttagtagagacggggttggccaggatggtctcacactactgacctcatgatccacccaccttggcctcccaaagtgctgggattacaggtgtgagcaactgcgcccggccgacacgtctcttctttaagccgccacttattggatctctatgttagagcggcagtctcatatattttctctcatattttcttctccacccctacaccttctgggagttctattttctgggataattaattaattaatcaatttttgagatggggtctcactctgtcccaggctggagtgcagtggagcgatcttggctcactgcaacctctgcctcctgggttcaagctattctcctgcctcagcttcctgtctcaaactcctgacctcgtgatccacctgccttggcctcccaaagtgctgggattacaggcgtgagccaccgcgcccagctttatttattttttaaattttttattcttgagacagagtctcactctgtcacccagggtggagtgcagtggcataatcttggctcatggcaacctccgcctcccgggttcaagcgattttcctgcctcagcctcccaagtagctgggattacagacgcctgccaccacacctggctaatttttgtatttttagtagatggggttttgctacgttggccaggctgatctcgaactcctgacctcaggtgatccgcctgccttggtctcccaaagtgctgggattacaggcatgatccaccacacctggcagttttctgggataatttattaactttttattacaacacttcctgtttgtgtttgtacagatgaggccttgctatattacccaggctggtcttgaacttctggcctcaagccattctccttggcctcccaaactgcaggaattacaggagtgagctactgtgcccagcttctttattctaatgcttttagtaattcagtatcatagctttaatttctaagaattcagtctttgctctatttatttatttatttgagatggagtctcactctgtcgcccaggctggagtgcagtggtgtgatcttggctcactgcaacctcctcctcctgggttcaagcgatcctcctgcctcagctcccagaatagctgggactacaggtgcctgccaccacacccggctaaatttttttttgtatttttagtagagacagggtttcaccttgttggtcaggctggtctcgaactcctgtccttaggtgatccacctgcctcagcctcccaaagtgctgggattacaggcgtgagccactgtgcctggcctctttcttttttataacaccctgtttttattgtaacatagtgtagcaattttttttttctttgagatggagccttgctctgtcgcccagctggagtgcagtagtggatctcggtttaactgcaacgtccgcctcccgggctcaaatgattctcctgcctcagcctcccgagtagctgggattataggcacctgccactgtgcccagctaatttttgtatttttagtagagacagcgattcaccatgttggccaggctggttcgaacccctgaccccaggtgatcagcccacctcggcctccaaaatgctgggattacaggtgtgagccactgcacctggccagcaatatcttttttttttttttttttttttttttggggaaagagtcttgctctgtcgcccaggctggagtgcagtggcgcgatctcggctcactgcaagctccgcctcctgggttcatgccattctcctgcctcagcctcccgagtagctgggactacaggcgcccgccatcacgcctggctaatttttttgtatttttagtagagacggggtttcaccatgttagccagaatggactcgatcttctgatctcatgatccacctgcctctgcctcccaaagtgctgggattacaggcgtgagccaccgtgcctggcccatctttttttttttttttaatatggggtcttgctctgtcacccaggccagagtgcagtggcatgagcacagctcactgcagcctcaaatacccaggctcaagtgatcctcccacctcagcctccagagcagctgaaattacaggcacgtgctaccacgccctgcccagctaatttttttttggaagcagcaccttcatttattagggacttcggtggggatggggaaaggcggcccccgggtcagaggcgccggaagaagagcttggagccgtggtctaacgtgcactcgctggggcccagctggctcccgcccagctctttttttttttttttttttttttttttgagatggagtctcactctgtcgcccagactggagtgcagtggcgcaatcttggctcactgcaacctctgcctcccgggtttaagcgattctcctgcctcagcctcgagtagctgggattacaggcacccgccaccacacctggataatttttgtgtttttagtagagatgaggtttcaccatgttggccaggctggtctcgaactcctgacctcaggtgatccacctgcctcggcctcccaaagtgctgggattacaggcatgagctactgtgcccagccccgcccagctaattttttaattttttgtagagacaggatctcactatgttgccagggctggtttcaaactcctggtctcaagcgatcctcccgctttggcctcccaaagtgctgggattacaggggtgagcctcgtgcctggcctgaagcagcattttctcaaatgtctttaaaaataccagatttttttttttctttttctttttttcttttcttttcttttcttttcttttctttttttttttaagacggaatctcgctctgtcgcccaggcgggagtgcaatggcgcgatctcactgcaagctcactgcaagctccgcctctcgggttcatgccattctcctgcctcagcctcctggtagctgggactacaggcgcccgccaccacgcccggctaattttttttgtatttttagtagagatggggtttcaccatgttagccagaatggactccatctcctaacctcatgatccacctgcctctgcctcccaaagtgctgggattacaggcgtgagcgatcgcacccagcctctttttctttacgtaaattctgtttcctccaggattacttttcttttctttttcttttttttttaaatttttttgaatgtacttaggatgcatttggctacaaataactaaacatccgacttacaggaagctcacagaagggggtggctgggattcagggccccttgatcaggcatttgcgatgccttgggatcccatgctcttcctcccattcctcctctgcaatcctgcaatgtttccatcctggggccagttcctctcagagttacaggatgtatccttaatcatggcttgtgggaggcagaagttactgcccccgggttctcttttaattaaaaggaagaagcctttcttagaagcctcccttccttttatcttagtggctagaactggggcatgtaccctttcctaatgcaatcgtgggcagaaggggagtggttactttagactggtcagactttgctggagctgaagaaggaaggggtcagtgcccaggatgtgtatgctggtgggcacctgaacaaactggggtacttttaggaaagaaggaggcagaatggatgatggggttggtttatcttggtgctttcctttcatgttgcagggtttctttgaatgttgttgatatttcttccaggcgtgacggctcatgcctgtaatcccagcagtttgggaggccgaggtgggtggaatctcttgcgctcaggagttccagaccagcctgggcaatatagggagacctctgtctctacaaaaattagccaggcgtagcggtgtgcacctcccagttttgctgggaggattacttgagcccaggaagttgagttgaggctgtagtgagctgtggtctcaccactgtattccagcctgggtgacagagtaaaaccctgtctcaaaaaaaaaaaaaaaaaaaaggttgatatttctttcaagtcccatcatacttcagagtgagccaataagaggctgactggggcttttggtaccagagtagagctttccaacttgagggttggactttcatatcaagtgtgagaataaactaaagacctatttaggtgcaagattactttgggcacggtggctcacgcctgtaatcccagcactttgggaggctgaggggtgacgatcacctgaggtcagtagttcgagaccagcctggccaacatggcgagaccccgtctctactaaaaatacaaaaattagccaggcatggtggcgcctgcctgtaatcccacctactagggaggctgaggcaggaggatcgcttgaacctgggaggcagagtttgcagtgagccgatattgccccactgcaccccagcctaggtgacagagtgagacaaaaaaaaaaagcaaagttcacctttttattagggagctttctttggatgtgacttgaaaatgtgctcctgcaaaattaagagggtaaatcacaaaagagaagggtgcagactacaggaaataggagatcccacccaagagagaaataaccactggtcccaagatgtagcagtgtagcaacagggagtgggaggggagaaggaaggtcacactggagcaaggaattagtgaagcaattagaaactctaggtaaaattaaaagagatgtattgtagtaaatttactatgatacattatcgtagtaaatatcgctaaaattttatatatatatataaatatatatatttatataatataactgaacaatagttatataatgctttttttttttttctgaggtggcatcttgctctgttgcccaggctggagtacaatggcacgatctcagctcactgcaacctccgcctcctgggttcaagcgatcctcctgcctcagcccccctagtagctgggattacaggcacgcgccaccatgcccagctaatttttttatttttagtagagatggggtttcaccatgttggccaggctggtctcgaactcctgacctcaggtgatccacccgcctcggcctcccaaagtgctgttattacagacgtgagccaccgtgctaggcatttttttttttttttttttagagacatggtctccctttgtcacccaggctgcagtgcagtggtatcatcatagctcactgcagtcttgaacttctgggctcaagtgattgtcccgtctcagcctcctgagtagctgtaagtacaggcatgtgctaccatgcctggctactttttttctttttttctgtacagatggcaccttgctatgttgccccagctggtcttgaactcctgacctcaagtgatcctcctgccttggcctctcaaagtgctgggattacagacatgaggcaccacatccagccccataatcttaaaaacaaagaaaattaatagttttccattttagactcaaactctggaccagacagcactgatcttgactatctgaggtgatagaaatagcctttatctgtgttatttgatttgatagctactagccacatgtggtttctgaacacacttgaaatgtaactagctagttgcaactgagggaactaggttttaaatctcattaaattttaattaagttaaagtagtctcctgtggccagtggcttctacattaggcaatgcagctctaagcaagatgaaagagagaatgccaatattatctacatttaacaacataaaagtaaatgtacaggtaacagaaatgagcagaagagagataaaggaaagccactatcttcatgtcacaaagtgataagaatttaggccagaagctgtggctcatgcctgtaatctcagtacttttggaggccgaggcaaggaggatcgcttgagcccaggaattcaagaccagcctgggcaacataatgagatccctgtctctacaaaaaaaattaaaaattagctgggcatgatggtgcacacctgtagtcccagctactcaggaggctgaggtaggattgcttgggcccaggagttcgagggtgctcatctctttaaaaataagtaaataggtcaggtgaggtggctcatgcctataatcccagcactttgagaggctaaggtggacggattgcttgagcccaggaaattgatctcagcctgggcaacagcgaaacaatgtctctacaataaatataaaaagtaaccaggtgcatgccgggcgcggtggctcacgcctataatcccagcactttgggaggccaaggcagggtggatcacaaggtcaggagatcgagaccatcctggcgaacacggtgaaaccctgtctctactaaaaatacaaaaaattagccgggcatggtggcgggtgcttgtagtcccagctactcgggaggctgaggcaggagaatggcgtgaacctgggaggcggagcttgcagtgagccgagatcgcgccactgcactccagcctgggtgacagagcgagactccgtctcaaaaaaaaaaaagtaaccaggtgcggtggcacacacctgtagttccagctacttggaggctgaggtgggaggatcactggagcccaaggttgcagtaagctgagatcaggccactgcactctagcctgggcgaaagagtgagaccctgtctcaaaacaaaacaacaacaataataaaactcatacataactacgtaaataaagttacaaaagcaactttagttcgttacaaaggacctgaagagagggatttaactgacctgcaaggtggaatggggctggagcagggccagtgggtcagacacctatgattatgccaggcaaaatggatacatgaagaaataaagttatagcatctccatgtagtaatagaaaaaaaaaaggaataacgaaattagcacactttttgggaatgtggacccaccagtagaattgagactagaaaaagttaaaagcattagaagtgttctctttctgagatcatgacttgttggggaaagggaagacttattgttcatgacaaacacttctgtgcttataacatgcattagcttaggaaacagcacttttctttttctctttttttttttttttttttttttttgagacaaggtcttgctctgtcgcccaggctggaatgcatgttgcgatctcggctcactgcaacctctgcctcctgggctcaagcgatccttccaccttggcctcccaaggcgctgggcgctgggattacaggcatgggccaccgtgcccggcctggtgcttttcagtgaataaataagtatgtaaacttctcttttctgactagacggaaattccccagaggacaagggtggcgtgacttgtcagtccttttcattgacagcgctgtggatgggaagaaagggcccctggtcccaagcaagccccagtcctgtggccctggaggatcagaagggtaattaagtgtcaaaggaaaacatagccagacatgagttactgtggtgaaaacagattttattcagtaactactcgtggtaggagaaagagctgagctccattctgatttgtgcagaggtgatttaggcatttaattagttaattagtttttgtgggacagggtctcgatctgttgcccaggcttgtgattgtgcctgttgctcagattgtgcagtggcacaatcatggctcactgcagcctcgaactcccaggctcaagtgatcctcctacctcagcctcctgagttagctgggacccacaggcgtatgccactgcacctggcttttttttttttttttttttttttttgaaacagagtctcgctctgttgcccaggctggaatgcagtggcatgatcttggctcactgcaaccaccacctcctgggttcaagcaattctcctgcctcggtctcctaagtagctgggattacaggcgcgtgccacaatacccagctagttttagtttgttttttatttatttattttttttagtagaaacgacgtttcaccatgttggccaggctggtctcgaactcctgacctcaggtgatccacccacctcggcctcccaaaatgctgggattacaggagtgagccaccgcaccagtgtctctctcttataacaccagctagtccttatcaggctttgactgtgggcccctcacctgtctaacttatccttcccaggaactttgaagaatactattattattcctattttgcaaatgaagaaactgaggcagattaaatgcctgacccaaggccatccagacggcaggcgatgcaggcaggagtcaagctcaggtacccctccccttctgtggcttccctgcctccaggcttctgccagcccctgtctaccttggtgtaggagcggcccctcaaagacctgcagggagccgggcacggtggcgcacgcctataatctcagcactttgggaggctgaggtgggcgtatcatgaaaccctgtctctactaaaaatacagaaattagccgggtgtagtggtgggcacctatgatcccagctactcagaaggctgaggcaggaggaacgcttgagaaccccagaggcggaggttgcagtgagccaagatcgagccactgcactccagcctggacgacagagcgagactccatctcaaaaaaaaaaaaaacctgtagagggaaggaggaactggggcctggggagggcagagctattatctcaggagaagcaggcaaacctctggtgacctctgatgacctcagggcaggatgggcaggccttcacaacagctccaggcacacccagcctcccgtccctggcctcatcactcccctctctgccctccaccctttggcctccttgcctttgtccacagttctgcagcctgataccctcttccttgtctcaaccagagaagtcttcagtcaataaacgtcatccaatgcctactgtgtgtcaagcacttcctgggtgctggggcactgtgcaagcacacacgcacagctgtgaggccatggggctggcattccagtgtggggagagcgacggaagcaaaataagaaagtccattacatggcgcatttgaaggcgcgaagtgctatggggagaaagcaaggaggggggttacagtccagagggaggggggtgcgattttttttttttttccagacggagtcttgctctgtcacccaggctggagtgcagtggcgtgatcttgcaaactccgccgcctgggttcacgccattcttctgcctcagcctcctgagtagctgggactgcaggcacccgccaccatgtccggctaattttttgtatttttagtatagacagggtttcaccgtgttagccaggatggtcttgatctcctgaccttgtgatccacctgcctcagcctcccaaagtgctgggattacaggcatgagccaccgcgcccacccgggggtgagattttaaatacaatggccagctgggctccgtggcacacacctgtaattccagcactttgggagaccgaggtgggaggctcacttgagtctaggagtttgaaacaagcctgggcaacaaagcaagatcccatctgtatgaaaaatttaaaaattaggccgggcatggtggctcatacctgtaatcccagcactttgggaggccgaggagggcagatcacttgagctcaggagtccgagaccagcctggccaacatggtgaaacactgtctctactaaaaatacaaaaaaattgctgggcgtggtggctcacgcttgtaatcccagcactttgggaggccgaggcaggtggatcacctgaggtcaggagttcaagaccagtctggccaacatggtgaaaccctgtctctactaaaaatagaaaattagatgggcttggtggtgggcacctgtattcccagctactcaggaggctgaggcaggagaatagcttaaatccaggaggcggaggttgccgtgagccgagatcgaaccattgtgctccagcctgggcaacgagagtgtgaaactccatctcaaaaataaaaataaaaatacaaaaaattagccgggcatggtggcgcgcacctgtaatcccagctactcgggagactgaggcgggagaattgctggaactcgggaggcggagttgcagtgaaccaagattgtgccactgcactccagcctgggagacagagcgagactccatctcaaaaaataaaaaattaaaattaaaagttagactggtgtggtggcatgtgcctgtagtcccagctacttgggaggccaaggcgggaggatctcttgagcccaggaggtcgaggctgcagtgagccatgattgtgccaatgcactcaagcctgggtgacagagtgagaccctgtgtctaaaacaaacaaataagtaagtaaataggttggccaggcaaagccatcctgagaaggtgacatttgagcaaagactgagaaagcagccaagcaacatctgggtggggagccctggggcagccaccacagatggcgcaaaggccctgggcttgctttctccagggacacatcagaggtccgggtggcaagggcgtggatggcagggccatgggtggaagggcagaagcaacgtggataagagaggtaggcaggggtcagatcggatgtggccaacttggcttctaccctgagtggggtgggagtggtctcagggctccaagcagaggaggggtggggtcagatgtttcatctgggtccctctggctgctgtgtggaaaacagcccggaggaggatgagatctcacacagggagaccagagctgagatgactgcaccagtccaggccagagaagacagaggctcaggccagtaggcagcagtgacggggcgaagagggatcagattctggatctttctctctctctctctctcttttttttttttttttttttttttttttttacagacaaggtatcactgtgttacccagggtggagtacagtggcgaaatcatagctcactgcagccttgaactcctgaactcaagcgatcccttctcctgagtctcccaaagtcctgggattacaggagtgagccactgtgcccagggcaggttatacattttttttgggaacaccacagaagccaagcacagtggctcatgcctgtaatcccaggacttctggaggcgaagatgagaggattgcttgagcccaggagttcaagaccagtctgggcaacacagcaagaacccatctctaaaaaaaaaggaatactgctgggcacggtggctcatgcctgtaattccagcactttgggaggctgaggtgggtggatcacctgagattaggagtacgagaccagcctggctaacatggcgaaaccccatccctaataaaaatacaaaaattagctgggcatggtggcagggacctgtaatcccagctattcaggaggctgaggcaggagaattgcttgaacccaggaggcggaggttgcagtgagccgagatcacatcactgcactccagccagggtgaccatgcccagccaactatgtaaatatcctatacacacacactcttctgatttcaccaatggttttaacactcactcttacctgaatccattattattatattggttatgtttatcattttttaaattctacattccttttacaattgttagctttcctacagtaaaataactttccagtggccgggcacagtggctcatgcctgtaatcccagcactttgggaggccgaggcaggtgaatcacgaggtcaggagttcgagatcagcctggccaacatggtgaaaccacatctctactaataatgcaaaaattagccaaacgtggtggtgcgcacctgtaatcctagctacctgggaggctgagggaggagagttgcttgaaactaagaggcggaggttgcagtgagccgagattgcatcactgcactccagcctgagcgacagagcaagactacatctcagaaaaaataaaacaaaaacaaaaaaaacttccatactgtcctacctcccttccctgctccctccctccttctctttgtctctaatattttcagaatcagtatgaactcattttcttttcttttttttttttttccaagacaaattctcactcttttgccgaggctggagtgcagtggcatgatctcagctcattgcaacctctgcctcccaggttcaagcgattctcctgcctcagcctcccgagtagctgggactaccggcgcccatcaccacacctggctaattttttggtaatttttagtagaaacggagtttcaccatgttggtcaggctggtctcgaactcctgacctcaggtgatcctcccgtctcggcctcccaaagtgctgggattacaggcatgagccactgcgcccagcctctttttttcttttaattaaaacaattaaatagagatggggttctctgtctgttgcccaggttggtcttcaactcctgggctcaagcaatcctcctgtctcgggctcccgaagtgctgggattacaggagtgagtcaccacgcccagcctaagtattgctcttctgtgatgatttgcaggcaacaatcacctcttgttcatattttcattatctttccctccaccccgagcctatagtctgtcttggtcagaccccatttcttgagtgcaccaggctggagtttggacccatccacatcctcgcagctctcctgagttggggcccaacatctggcttggggaacagacagctttgccgacagcagtaacaatttggttgaaatgataactttgtcaaaaatgaattttgccttagtgtttttttaaaggttgagaatcttgtacattcttacaacatttctattttctacagttaaaaaactgtaggctgggtgcagtgactcactcctgtaatcccagcactttgggaggccaaggtgggtggattgcttgagtccaagggttcgagaccagctaggcaacatagcaaaatattagctaggtgtggtagctactcgggaggttgaggcaggagaattgcttgaacccaggaggcagaggttgcagtgagccaagatcatgccactgcactccagcctgggcaagagagctagattgtctcaaaaaaaaaaaaaagtaagttccaattactttgcagccaattattcttgctcttctatttgcaatagcagaagattgaaatagcctcctagatgtctgacagtggaatgggttcttttctttttcttttttggtagagatgagggtctcactatgtggccaggcaagccttgaactcctggcctcaagtgatcctcccgcctctggaggcaggaggtagggtacagtcccagactcaaagcactgggattacaggagtgaaccactgcgtgagcctggtttcttttctttcccctccctcccttccttccttccttccttccatccgtccttccttccttccctccttctctcctctttcactctacctctttcttttcttcttttttctggcttgttaaaacagaaatacataataattatagtgaaataaactagggtatttactgcagcagttagtaataatgaaatgttggaaaacaatctaatgttcatccgtagggaatatttaaaatatagtgtatttctgccgggcgcggtggctcacgcctgtaatcccagcactttgggaggccgaggcaggtggatcatgaggtcaggagatcgagaccacggtgaaaccctgtctctactaaaaatacaaaaaagttagccgggcttcgtggcgggcgcctgtagtcccagctactcgggaggctgaggcaggagaatggcttgaacccgggaggcggagcttgcagtgagcagaaatcgcgccactgcactccagcctgggcgacactgtgagactccatctcaaaaaaataaattaattaaaaataaataaataaataaaatatagtgtatttctggccgggcgcggtggctcactcatgtaatcccggcactttgggatgctgaggctggcagatcacaagatcaggagatcaagaccatcctggctaacgcggtgaaaccctgtctctattaaaaatacagaaattagctgggcatagtggcatgtgcctgtagtcccagctacttgtgaggctgagacaggagaatcgcttgaacctgggaggtggaggttgcagtgagctgagatcgagacactacgctccagcctgggtgacagagcaagactccgtctcaaaaaaaaaaaaaattatagtgtatgccatggaatattatgcaactgttatatatgtgtgtgtgttcccaaagcattgttcagtaacaaaggaaaagtgcaaaacactaaaatggatgaatacatgcttgtgtaaacacagacactgtcaggaatgtttgtctggaggtgatgggtatggagcctttttgtctgatatattgggtgtatcaagaatgccaggtcctgagcagttttttttttttttttttgagttggagtctcactctgttgcccaggctggagtgcagtggcacaatctctgctcactgcaacctccacctcctgggttgaagcgattctcgtgcctcagcctcccgagtagctgggattgtaggcgcccgccaccatgcccagctaattttttgtgtttttagtagagacggggtttcaccatgttggccaagctggtctcgaactcctgacctcaggtgatctgcctgcctcggccttccaaagtgctgggcttacaggcatgggccaccgtgcccagccgtttatatgtattaactcttaatcatcaaaacaaactatgtggtattaccataattatcgccatttatacaaagcaacagagggataaggagattaaggcacttgcccaagtgcaagaggtaggacaggaacccagagtcccgtgctggtagctgcttttctgtgcacttaacattatctcatttaattcttgcagtcacttcatgaagaaggtggcggtcctagggcattggagaagttatgtgcttgttcaaggtcatgcagctggaagatggtggtggtaggacaggaagtctgtagggcctgattctgcagccctctagtctatactcctttgctcctgtgtccctcatcccccctgcagaatgggcaccccgttacctttctgagccactgtgcgcagaaaagagagcatgttggccaggctggtctcgaactcctgacctcaagtgatcagcctgccttagcctcccaaagtcctgggattacaggcgtgaaccaccacgctcagcctctgaatactttgtactcaagccatttttcagtgctgtgtttgcagtgagcacacccgagggatgaagacacgtctccctgtgggaacctgggcttaccagggcccctagaggaggggaatctctcaagctcagagctctatggctgcggtgcaggcccactgtgtgcatggtgtcagtctgggcccttccatgttgcccccgtgggacttggggtaaggggaactgatgcaaacatcacgctgctgttgcttggtgtgagcaattaattcctgtggctctcacccaggagtctcatgtctttgggtcagacaaactcatcagcttgtagaaatggcacagtcccacgggcctgttagaatcttctattgtgcacatgttgctcttaaaatatacaaatcagttttgattttaaaaaattatttatttttttagtgataggagttttgctacgttgcccaggctggtttcaaactcttgggctcaggaggtcctcccactttggcctggactgccagcataatgtatcaccacacccgggactgattttcgtttttcaagaacaaaaaccaaaaacatacacaaaccgagagtcaaagcttgctaattagaggaaagtcaggaaatgggaaccattcaaagaagaaaatacccccacctcctactctcacctatccaaagacaattaggtgaatcccttagtagatatctttccagacggttttccatatagattcccatatctggccaggcgcggtggctcacacctgtaatcctagcgcttggggaggctgaggcggatggaccacctgaggtcaggagttcgagaccagcctgaccaacatggagaaacctcgtctctacgaaaaatacaaaattagccgggcacagtggtgcaagcctgtaatcccagctactcaggaggccgaggcaggagaattgcttgaacctaggaggcagacattgtgctgagccgagccaagatcatgccattgcactaaactccgccttaaaaaaaaaaaaaaagattcccacatctttactagtttgcagaaataagatcctagcatatgcagtgtgtaggaaccaccttggtttagccacgtctctgtgactgggggccactgtggtgacccccagctccccggacagagtcaagagctcaccagcctgcaaaggttttcacggcccccagccagactcgggggcttcctcttgccctgctacttcctgggagctctgagggcaggaaatggcgccactcagctcctggcctaacagcttggggaccacaaatgcaaaggaaaccaccctcccctcccacctcctcctctgcacccttgagttctcaggctcacattcccaccacccacctctgagcccagccctccctagcatcaccacttccatcccattcctcagccaagagccaggaatcctgattccagatcccacgcttccctgcctccctcaggtgagccccagacccccaggcaccccgctggcccctgaaggagcaggtgatggtgctgtcttcgcccagcagctgtgggagcaggcgggtggggcaggatggaggggtgggtggggtgggtggagccagggcccacttcctttccccttggggccctgtccttcccagtcttgccccagcctcgggaggtggtggagtgacctggccccagtgctgcgtccttatcagccgagccggtaagagggtgagacttggtggggtaggggcctcagtgggcctgggaatgtgcctgtggcttgaaaagactctgacaggttatgatgggaagagattgggagccattgggctgcacagggtcagggaaggccaggaggggctggtcactgctggaatctaagctgctgaggctggagggagcctcaggatggggctgatgggggagctgccagcatctgttcctctgtcatttctgataacagtaaaagccagcatggaaaaaaccgttaaaccgcaggttgggcctggccgttggcagggaagtgggcagaggggaggcccggccaggtcctccggcaactcccgcgtgttctgcttctccggctgcccacctgcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctctctctcacacacacacacacacacacacacacacgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctcaaaaaataaaaataaataaaataaataaaagagaggcacaaacagtgttatgaatgcaccaaggaaaatggtgcattcataactctcaggtgaagcctaccaagccatgcgtgtgtgcacatatgtgtgtacgtgtgcatgtgcgtgcgtgcatgtgcgtgcgtgcatgtgcctgtgtgtgtatgtgtgcacatgtgtgtgcgcatgtgtgtgtgtgcgcgcatgtgtgtgtgcatgcatgttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaatttttttttttaatttttaatttgtacagacagggtcttgctgtgttgcccaggctggtctcaaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgagtctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttggaaaaaaatttaaaaaaagaaaatataaaatatggtataagattaaatatattagttatgaaaataattgtaaatggcttattgaacttatagtcagtaaaaatcatgtttttgaaaattatgtaatgactttggaaaataccagcaatataatgttaagtggggaaaaaagcaagttactcctctgtaatacatatgattttagttttgtaataaaaattcccaaccatatatgcacttatagggaaacaaaggacccatcgcaaatgttttccatgctgatctccaaagtggtgagtttatgtgtgatttttattttgtttatgctcttctgtattttccgaatttcatacaataaatatctgttacttttacaatatgaaaaaatagtggtcaaaaaggtgttcaagggggtggcctgggggtgtctggtttgaggagagtggtaggggatgaggctgcaagtggaggttggagccatgctatgaaaagttcaagagtttgaattgagttctgaggtttgtttttgtttttgtttttgttttttgagacggagtctcaccctgtcacccaggctggagtgcagtggcacgggttcatgccattctcctgcctcagcctcctgagtagctggaaccacacgcgcccgccaccacaccaggctaatttttttgtatttttaggagagacagggtttcaccatgttagccaggatggtctcgatctcctgacctcgtgatccacctgcctcggcctcccaaagtgctgggattacaggcgtgagccacagtgctctgcgtgagccatagtgctctgctgagagtttgaattgcattctggaagtagtggtgaaatcaacacacctaagtctgctcttctcctctcttctagtccccagagtggtgagtagcatcgttctggtggcccaggcaaaacgccttaggaccaccgtgcagccccactctttccccattcctgctctccaggtgccaagtccctggctcttcttccaccgacccttgcatcccttccttctcttcagtcctcatcgcacctcaccgggatcctattgacacttcccctttgatttccttccgctctctgctagtgatggtcccagggacccttctaaaaggtcactgtgggctgggcacagtggctcacgcctgtaatcccaacactttgagaggctgaggtgggccaatcatctgaggtcaggagttcgagaccagcctggccaacatggtgaaaccccatctctactgaaagtacaaaaattagccgggcgtggtggtgtgcacctgtagtcccagctactcgggaggctgaggcgggggaattgttggtccccgggagatggaggttgcagtgagccaagatcgcgccgttgcactccagcctgggtgacagaatgagactccgtctcaaaaaaaaaaaaaaaagaaaaaagaaaaatagctgggcatcgtggcacacacctgtagttccagctactcaggaggatgaggtaggaagatcacttgagcccaagaggtccagactgcagcgagtcatgatcacaccactgcactccagcctgcgtggcaccctgtctcaaaatataataataataaaatttaaaaataaaataaaacgctgctctgtctaggtgatattcctctatccccaaggctgtcagggtggaaccctccttccttagcgtggcatataagcccctcgggacctggccctatctctcctctgaccacccctgcccggtcagcccttgttacagacagtctgtgctatccagccccatcaaattcctgttgctccctaaatatgccacacactttatttggaggagaggggtgaagaagggtagtttaacatgttcaaaatatttattttttccagacagtaaaataacattttttcctgttttgcaaaagttaattatcagcacattgaagattttccttttttttcttttctttttttttttttttttgagtcaaagtcttgctctgttccccaggctagagtgcagtagcgcgatctcggctccacctcccgggttcaagtgattatcctgtttcagcctcccgagtagctgggactacaagcacatgccaccatgcccagctaatttttgtatttttggtagagacggggtttcacaatgttggccaggctggtcttgaactcctgacctcaggtgattcacccgcctcaccctcccaaagtgttgggattacaggcatgagccactgcgcccggccagcagtcttaaataacagaattcacacacacacacacacacacacacacacacacacacacgcactgtattatatttcatcttatactttaaaatgtttccttttttttcctcaaaagtacacattaagatcatgtttacaaataaagccttgtcatccaaagtgaaaaatccagatggcaagatttggatggggaaggtcttgagaaatctgcgaatggagttcacttttgcagacaggaaatgggccctaatatatggttctaaggacattccatttctgaaaatgtacatttccacccgcttttcctctccttccttcctccctccctccctccctctctctctctctctctctctttctttctttctgacaaggtcttcctctgtcgctgacgctggagtgcaatggtgcgatctcggcccattgcaacctccgcctcctgggctcaagtgatcctcccccctcagcctcccaagtagctgggaccacaggcacacgccacggcacccagctaatttttgtattttttgtacagatgggttctcaccatgttgcctaggctgatcttgaactgctgggctcaagtgatcctcccgcctcagcctctcaaaagtgctgggattacaggcgtgagccaccgcacctggcctgcatccccatttctgacccttgaccatgttcaagtgggaaggggaagccggggaagggaggacgggctacctgagggctgcgggtagaggtgactcctgtgagctgtgagccctcagcccttgggcagagggaacagaacagaaacagaccccatctctgagccaccaagctcagactcgtgtggcaggagacagatcacacaacactatcaacaaaacaacacaggtcgcagtggctcacacctgtaatcccagcactttgggaagctgaggtgagaggattgcttaaccgcaggagttcgagaccagtctggccaacatagcgagaccccatctctcaaaaaaagaaaaaaattagctgggcctggtgatgcacacctgtagtcccagctacttgggaggctgaggtgggaggacagcttgaaccagagaggtcgaggctgcagtgagctatgattgtgccactgccactgcactctagtctgagcaatagagtgagaccctgtcttccaaaaaaaaaaaaaaaagagagagagagagagaagaatataatcaaaagtttctaaattcccaaagtagtaacaaaagcagacccaaacaaaagtagagagaaaatcttcgaaacttaaaaggctatttaggctaaggagcccacccagtggtgaccacctagttctgggaggtttggggcagggccattagacaatggaaactcaggttattttggagacaatcaacttgctcccaaaaatgagctgcaagcaggtgcctgtgtgctcagcccagtctggagctcagagcctgcctgccccactgcaccatcaccagcccagctgaaccagggtcccaggcaagccgtacaggctctgcgttggccttggagagaaccgccgactcccccgagttgcctgagctcggcctgaagccagccctccccacgctggctcacaataaatgccttgacttcccgccaactcttcctcaaccattaagattcagctcaactgtcacgggctctgtgcagctgccctcgctgccccaccccacgcagactttgtgttccttctccactcctgcagcaccccttgcgacagcatgaataacccggctgtagtgatgtgagggtgacactcatcaccagtgtgtgagcccctccaaggccacatgtcctctttgtgtttccagagcccagggcccagcatgcggtagctacctagtatatgtttactgaatggagggatgaataaattcatgcacaaagaatagttttatttatttatttatttttgagacagagtcttgcttctgacacccaggctgtagcgcagtggtgcgatcttggctcattgcaacctctgcctcccaggttcaagcaattctcctgtctcagcctcccaagtagctgggattacaggcatgcgcgccaccacgcccggctaattttctatttttagtagagacgaggtttcaacatgttggccaggctggtctcgaactcgcgacctcaggtgatctgcctgccttggtcttccaaagtgctgggattacaggtatgagccaccgcgcctggccttatttgtttattttcataaacaaatttctgttgcccaggctggtctcaaactcctggcctcaagtgatcctcctgcctcagcctcccaaactgttgggattacaggcacaagccacagtgcctggcccagttctgtcctttgagttgacctggtcatccaggaggatgttctgaggaagtgtgaaatgataatattattctagcccacgctggatacagtggcagtctggaaggtgaaagaggttgggtttgaaatagatttattggccaagtgcagtggctcacacctgtaatcccagcactttgggaggccgaggcaggagaattgcttcagcctttaaacatggcgaaaccctgtccctattaaaaataaaaaagttcgatgggcgtggtggcattcacctgtagtcccagctactcaggagggtgaggcaggagaatcacttcagccctataggttgaggctgctttgtgctgtgatcatgccaatgcacgctagcctgggtgacacagtgagaccctgtttcaaaaacaaaaacaaaaacagaatagaggcctggagcttgagagggaactcaggatagaagatatagatttaagagtcggctggatgcagtggctcaaggctgtaatcccagcactttgggaggctagggtgggtgtatcacttgaggtcaggagttcgagaccagcctgaacaacatggcgaaaccccatctctaccaaaaataacaaaaactagctgggcatggtggcatgcgcctgtaatcccagctacttgggaggctaaggcaggagaatcacttgaacccgggaggtggaggttgcagttagccgagattgtaccactggattccagcctgggtgacagagtgagactccctctcaaaaaataaaaataaaaataaataaataaataaataaataaatagtgatacagatagatagatacataaattatatcattcactgggtagattgagaagagagctgtagagagaatctgagtgtaatagtcagggcaggctaactgctgtaagaaacagtgcccccacatctcagcggtataactcaaaagaagttttttccttcttatgacagtcaattcctgacatctggagcatgacctttcacaacattattccgggacccagtctccttccatctagtggctctgtcatcctcctagggccttggagtggtctgcttttgaccagctaatgggaggggagaggcagaataggatcctgtgaagacttctagggtcaggtctggaaatatcttttgctcacactccattggccagaacaagactgcctcagtgcagaggaagctgggaaatgtagtttagtagggtacccagaaggaaaagggaaacagtctctgccacactgaagcaacaccaaaatctgagggttggatgtaggaagaagcacctgcaaaagatagaaaagagcctttaagaggatcacctgaagccaggagtttgagaccagcctgggcagcatagcaagatcctatctgtacaaaaaataaaaataaaaaattagcctagggtggaggcatgcacatacagtcccagcaactcaggaggcttggggccaggagtttgaggctgcagtgagctttgattgggccactgcactccacttaagcctgagtgacagagcaaaaccctgtatccaaaaaaaaaaaaattaaccaggagaaaaatgacatttggagatcctgtctctaaagaaaaaaaaagctcactgcatagctcactgcagcctcagaaacaggcccaggactgaatcaaggccagcaaggtgctggggtgataagcgagcccgactccagcctggccaacacggtgaaaccccttctctactaaaaatacacaaattagctgggcatggtggcagacgcctgtggttccagctactcaggaggctgaggtaggaggatcacttgagcctggggcgtggaggttgtagtgggccaagattgtgccactgcactccagcctgggtgacagagcaagaccctgtctcaaaaaaaaaaaaaaaaaaaaaagtgagctggaggatgaggcctccctaaattttgtgccttgggtgtctcgatccgtcacgccagccccagtcccggcagtcaggtgcggcagagaaagcaaagggagaaggctgggaagatgcaagtgaatttagcgactagcagtccctgtgagcaactgtagcaagaagggtttccaatgaagaaaggaaggccctgggccaggcgcggtggctcatgcctgtaatcccagctctttgggaggcagaggcgggtggatcacctgaggtcgggagctcaagactagcctgaccaacatagagaaaccccgtctctactgaaaaaaaatacaaaattagccgggtgtggtggcgcatgcctgtaatcccagctattcgggaggctgaggcaggagaatcgcttgaccccgggaagcggaggttgcagtgagtcgagatcacgccattgcgctccagcctcggcaacaagagcgaaactccatcaaaaaaaaaaaaaaaaggaagaaagaaaggccctggcagttcttggacaggaacttgcctgaagtcccagtcccggtgactggtggtttccccactttctggttcagaagctgggctctaagctgtctgtgcccttaaagttccttggaaagagggaagggaagggaagtggatattaggtgagttcctactctgtttcatttgcagagttttctcattgattctcagttggacccatgaggtagatgttatgccattacattttttttttctttagagacagggtctctctctgtcactcaggctggactgcagtggcacgatcacggctcactgcagctttgaactcctgggctcaagtgatcctcccatctcagcctacaggtgtgcaccactgtacttagctaatttctttttcttttttctttttttgggagagatgggatctctgtatgtctctatgatgcccacactggtctcaaactcctggcctcaagcgattctcctgccttggcctcccaaagcacagggattacaggcatgagtcgctgtgcccagcctgttatgccgggtttttttgttttgttttgttttttgagacagagtctcgctctgtcgcccaggagtacagtggcatgatcttggctcactgcaagctccacctcccgggttcacaccattctcctgcctcagcctcccgagtagctgggactacaggcgcccaccaccacacccggctaattttttggttttttagtagagacggggtttcaccatgttagctgggatggtctcgatctcctgacctcgtgatctgcctgcctcagcctcccaaagtgctgggattacagtcgtgaaccactgcatccggcctgttatgccgttttttaaattaattaataaatttatttatttatcttgagacagagtctcactctgtcacccaggctggagtgcagtggcatgatctcgactcactgcaacctccacctccggggttcaagtgagtctcatgcctcagcctcctgagcagctgggattacaggcggccgccaccatgcccggctaatttttgtatttttagtagagatggggtttcgccatgttggccaggctggtctcaaactcctgacctcaggtgatcaacctgcctctgcctcccaaagtgctgggattacaggcgtgagctcctgtgcccggccctgttatgccattttaaagctaaggaaactgaggcacagaaaaaggtaaaaaggtacttgagatcaaaaaggatggagttaggatttgaacccaggtccagggcccatgattttcccagcacaccatccaaaatgcctgcctgccctcaccagggagcacatgcttacattcacagccttggaccctgggttagggccaggagggctgggtgttgggtgagaacagggcctcgggctccttcactggctggggcagggcttctgagttccccatcagagcccctcctctgactttcagggcctgctgaggaatctgcaggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggtaaagggacactctctctgccatgtccctgcacccatccccccactgcctacccctgcccccaccctggcttgtctcagccccttgttgcctcctctggagtcatctctcctctggtcccgccatcgactcccttacctaccccatgtccctgcagccttgctcaacccccagaggccccttctcactcttctttctcctgtgttgagtccccaaggagctctggggaaggaaggggcttaagccctagaaaagggcagggtggcctggaggaggtggcgtctcctgggggcagtgggggccggaagtgggaggctggttgggggagcagcatggacttctgctctcgctggtagctcgggagaagcagagacaaagtcctgtcccttctgcagctgggtgggggagggggcttgagtcccgtgattccctgcctggagggagctgtatgcaaactgttggggtgatcagtcccaacccccaaccatgaagtccggtggcaacaaaggaatgagaaaagacaagttaagatttaaagcagccccagggggccagttgctaaagtgaaggctgcagagccctggttgcctgataatttattgagtacaatcttttgatctaagaagcagatggtacggggtgaaacggtgaaggtgggggtgtgcgcgtcatttgaaagatgtatagccgtggtggtttatgtgaatttcctttaagctcaaagcatatgtctaactactaagataatcttttttttttttttttttgagacggagtctcgctttcccccaggctggagtgcagtggcgtgatctcggctcactgcaagctccgcctcccgggttcatgccattctcctgcctcagcctcccgagtagctgggactacaggcgcccgccgccacgcctggctaattttttgtatttttagtagagacggggtttcaccatgttagccaggatggtctcatttcccaacctcgtgatccgcccgtctctgcctcccaaagtgctgggattacaggtgttagccaccgtgcccggccaactaagataatctttaacttattgggctgcagctggtgggagtgggttttacaaggagccaggatgtctggtcacattccaacgcttcaaggaagtgtttcagcccagagcattctgtgtaaagccgcagagcaggtcatgttcactggcctggggacacaatggcaataaggaggtgattctcctcagaggccccctatggtgttccataggtgtcctacacaggggtggctgactaaactggcgccccgtaaacccttccaccagcacaaacccaggggtccatgctctacgctcagaaggctccaccagggatggggctgtgtgaccatgggtgggtcctggcttctcagagtcccgttttcttccatctgtaaaatgacaataatagttccctgctctggcccgccacggtggctcacgcctgtaatcccagcactttgggaggctgaggtgggtggagcacttgaggtcaggtgtttgagaccagcctggccaacatggtgaaaccccgtctctactaaaagtacaaaaattagccgagtgtggtggtgcgcacctgtaatcccagctacatgggaggctgaggcaggagaattgcttgaaccccagtggcggaggttgcagtgagctgagaccaggcctcagcactccagcctgggcgacagagcgagactccatctcaaaaaaaaaggaaaataaatagttccctgctcagaaggttgtggggaggacagaggatgggaggcacaggtgcttagaccctcctccatgtttgaggtgcctgctggccccatacacccggtccctctggctccactgtggaaccagctctcaggggtcccatgcaggatgccacgccaaacacctttcaatctccattgtgtctttctcttttgaaacaacgccgacctggatgtgaatcctgactgccactcagcagcagtggaaaccctggcaagttttgtaacctgtagaagcccgtttccacatctggacaatggagttggtggcactggtctcacggggttgtaatgaagattaaataccttagcagatgtcaaggggtctcgacctgattccttcagagccaggattctttactgagggatcagggatgggctctgggggagttcatgaaccccagaatttgcaggtgaaattgtgtgtctttgtgagaacacggttacgcatttttctgggaaggagatccataattttcatcagatccagattctttttttttttttttttttttgagacagagtctcgccctgttgtccaggctggagtgcagtggcatgatcttggctcgctgcaacctctgcctcccgggttcaagcgattctcctgcctcagcctcacgagtagctgggactacaggcataaaccaccatgcccggctaatttttgtatttttagtagagatggggtgtcaccatgttggccaggctagcagatccagattctttttttttttttttcgagatggagtctgactctgtcaccaggctggagtgcagtggcaggatctcggctcactgcaaccttcacctcccaggttcaagtgattatcttgcctcagcctcacgagtagctgggactacacgtgcttcaggcacttgctgccatgtccagctaattttgtagttttagtagagacagggtttcaccatgttggccaggatggtctcgatctcttgaccttgtgatctgcctcctcggcctcccaaagtgctgggattacaggtgtgagccaccgcacccggcctcttttgttttttagacggggtcttgttctgtcacccaggctggttggtgtgcagtaacataatcatagctcactgtttgtagcctccaacttctgggctcaagtggtcctcctgcctcagcctgtggagtagctgggactgcaggcgtgtgccaccacacctggctaattaaaataaattttttttttttttagagatgggttcttgctgtgttgcccaggctggtctcaaactcccagcctcaagcgatcctccaacctcagcctcccaaaagtgttgggattacaggcatgagccaccgtgcctggctcaaatcttttcatatgtgaacatctcagcatgttttctttctttcttttttgagatggagtttcgctcttgttgcccagactggagtataatggcgtgatcttggctcactgcaacctctgcctcccaggttcaagtgattctcctgcctcactctcccaagtagctggggatacaggtgcccaccaccatgcccagctaatttttttgcatttttttttttagtagagatgggttttgccgtgctggccaggctggtcttgaactcctcacctcaggtgatccacccaccttggcctcccaaagtgctgggattacaggcgcaagtcactgcgcccagcctcatcatgtttttttcttaaaagataaagacttttctttttactacaaccacaatactattgtcaaaactaaactttaaaaatttccttggtgttatcaaacattcaatgtccagattccagtggtttcataaatagcctaatttgcttttagtttgtttgaattaggatctaagtaaaatctacactttgtgattggttagtatgttttaagagtctttgaaactttatttttttgattaaaaaatgtttaatttagagataggggtctcactatattgcacaggctggtctcaaatgccccaaagtgctgggattacaggtatgagccaccacacctgactgattctttttttttttttttgagatggaatctcactctgttgcccaggctggagtgcagtggcgcaacctcggctcactgcaacctccgcctcccagattcaagcgattctctcaccccagtctcccgagtagctgggattacaggcgtgcaccaccacacatggataaattttgtatttttttagtagagacagcgcttcaccatgttgtccaggctggtctcgaactcctgacctaaggtgatcttaggcccaccttggcctcccaaagtgctgggattacaggtgtgaccaccacgcccagccaatatgtggtcttatgagagcattggttcttttttttttttccctgaggcagggtctcaccctgttgcctaggccagagtgcagtagctccatcatagctcactgcagcctccaactcctggactcaagggatcctcccacttcagccttctgaatagctaggactacaggcgtgtgtcaccatgcccagctaatttttaaaattgtttttgtagagatgggttctcactatgctgcccaggctggtctcaaactcctggcctcaagcgatccttctgcctcggcctcccaaagtgttgggattacaggcatgagccaccgcccctggccgagcattgattcttgatcctcatgtgcatctgagtcacagagcagggtgggggctggctcttccccaacctggatccctggaaactacccccagagattctggttcactgggttggaatgggcctgagcatctgaaagtttgaaaagctccctgtgattctggtgtgcagcccaggcagaggccccactgtgtccacttctcttgaaaggagtggttcacaccaacacccccacttccctacctcccgtgcgctcctcgagcatgacaatgtggcttctgcccccgacacatggcacaaaaaccgctctggcacaggcctcacagttgctaagtgcagagccccatcctcagtcttccttctatttacttctgctcacctcccaaaaccctcttctccttcccaggtacccactcctgatgatgcttctctttttgttggacatgccctgtgggttctttatcttattattttattttagagaccgtggcttgctctgtcacccaggctggagtgcagtggtgcaatcacaggtcactgcagcctccaactcctggactcaagccgcagcctcccgagtagctggcgagtagctgggactacaggcgtgcacccccatgcccagctaactttttctttttttcttttgttttttgagacggagttttgctcttgttgcccaggctggagagcaatggcactatctcggcttactgcaacctctgcctcccaggttcaagcgattctcctgcctcagcctcctgagtagctgggatcacaggcgcccaccaccacgcctggctaatttttgtatttttagtagagacggggttttgctatgttggccccggagttcaatttttgtatttttagtagagacggggtttcaccgttttcaccaggatggtcttgatctcctgacctcgtgatcctcccgcctcggcctcccaaagcgctgggattacaggcgtgagccaccgcgcctggccacggcagcatctcttctgaactccagagccattccctaccaccctctgggcaccaccatccacatctcctgctgccgcctcagccttaacctctgcaaaaccaaatccgttctttctctcgagctctgcagaagctaagctgtttcaccaggccacgattcaggaaacgctttgggattcagcttctgttcttgtgaaatgggaagaatccctgtggtgagctccagatgagagcacaaaggggaacaggggtgcccgcggctggcacgccatggctggcacgccatggcactcagtggggtcaccgccccctcctgctgtcccacctccaccctgcctgctcttctcctggaatgactccttctgccagctctcagctacccaggccagaggcccaaggctcccacatctctttagctactaattctggtagatccccttttggaaatagccctcaaatctaccccagagctactgtcaaagttcagggctccatctcttttggtttttttgaaaatattttttcaaattaattatttgttggccgggcgcagtggctcacacctgtaatcccagcactttggaaggccgaggcaggtggatcacctgaggtcaagagttcaagaaccagcctgaccaacatggtgaaaccccatctctacaaaaatacaaaaattagccagggatgatgctgcatgcctgtaatcccagctactcgggaggctgaggcgggagaaccacttgaacccgggaggcagaggttgcagtgagttgagatcacaccattgcactccagcccaggcgacagtgagactccgtctcaaacaaaaaaaaattatttgtggaggcagggtcccactatgttgcccaggcctcaagtggccctcctgccttggcctcccatagcactgggattacaggtgacagccaccgcgcccagcctactttttgtctggccaagactacctcagccttcttttgcctcccaatctgtctccagttggtggctgaagtgacccttctggagcaaaaccataatcatatcactccctcttttaaaattctgtgatgggtcaggcatggtggatcacacttgtaatcccagcactttgggaggccgaggtgggaggactgcttgagcccaggagttcaagaccagcctgggcaacatagcgagaccccccgtctctacttaaaaataataaaataaaatgaaaagaaaattttttttgagatggagtttcgctcttgttgcctaggctggaatacaatggtgggatctcagctcacggcaacctccacctcccgggttcaaccgattctcctgcctcagcctcctgagtagttgggattacaggcatgtgccaccatgcccggctaattttgtatttttagtagagacggggtttcaccatgttggtcaggctggactcgaactcctgacctcaggtgatcggcccacctcggcctcccaaagtgctggaattacaggtgtgagccactgtgtccggccaataaaatgaaattttatgatggcttctgcgatctggccaaattcctcagctaaatagtttagttctttctccctgtggcctctcctcccaccatgtcacctgtgaatcccacactgcccccaccccgacactgtctgcaggtgaacagatcagttttctcagccccaaatgtcagccccaccccacacctctgcctggcaaacatcactcaccggtcctcagagacacctagtcatttattccatgagtccaccacacttgagaaacgcttcttttcttcgcgagcacgcctaccctgtgctagacagtgttcctaagggctttcaaacataaagtcttttgttttttgtttttgagacgcagtcttgctctgtcgcccaggctggagtgcggtggcacaatcttggctcactgcaacctccgcctcccaagttcaagcaattctctgcctcagcctcccgagtagctgggattacaggcgctcggctttttatttttttaattttttttattttttgtatttttagtagagacggggtttcaccatcttggccaggctggtcttgaactcctgacttcaagtggtccacttgcctcggcctcccaaagttctgggattataggcgtgagccactgtgcccagcctccaactcctggccttgtcttcctcccaccctggcttcccagagtgctgggattaacagacatgagcctccacacctggcaacttctttccatttttcactgattctctgacacatcctcattgagcacctgcactgtgtggggtgttaataattgctaggcatggaggcaacagcgtgggcagctctttctcttacttgtcaggctttagcctatgctgttgcaggactgtgccttggcctggaagccccttcccttatcctcatccccaatctcccccttcagctcttgttcctcttgcaggtcttcccttaaacatcacttcctcagcaggggcctcacagacacgcccggaggttagatcctggtccctctgtgcttcctgttcttcccccatcatcacagtctacggctgtttcctctcgatgggcaaagactgtgtctggccattgagttttctgctatatccaagtgcttcgtatactgaaccatataaatgtgctgcttttattggtcaaaacggccaaatattggcaattttatattggttagcttcatagtatgtgagctaggatacttatcccatcagagaggttgcgtagcacagtgaatcagagcccaggctctggggccgcacacctgaggtccagccctggctctgccacttgtcactaagtgattgtggactggagacaaccctcaggggccttgggttcctaatctgtgacagggatgacaataatgacctcctcgtgctgttataaaatacagaaatgtactaaaatacaaaaattggccaggcatggtggcacatgcctgtaatcccagctactcaggaggctgaggcaggagaactcaggaggcagaggctgcagtgagtctacttttattgccaaagctcgggggtccatcccttttccattgcatgccactgcactccagcctgggcaacaaagtgagactgtctcagaaaaaagaaaaagaaaaaaatgtttaaaagccaggagtttgagaccctgtctctattaaaaaaaaaaaaaattaccttggcatggtggagcagctactcaggaggctgaggtgagaggaccacatgagcccgggagttcaaggctgcagtgagccatgattgcaccactgcattccactctgtctcaaaaagaaagaaagaaaaaagtcaagagaactggagctgaaaccatgaaaggtcagttttcagcaggagagtgatcaaagaaaaccagaactagacagtcgttaaaatagcaaaaacatattgcattccagactattgctgtaggggaagagtgaccttagatcagaactgggctgaactctacaccatgggggttatagccaacgagcagagttgggggcagtggatgggacattaccatgagaaagcactgggggttgggggtattctgacaagaccaacctaaagggattcttgctgagggcaggccaaggtggtcagacagcgcctgggggagagtggagaatgaggacccccatcagggatcgggggcaatcagatgtggaggatgagggactggctaagctgacttagcagtattcttgctaaaattggacgatgcagaggtgaacacggaagtccaaggcctaactggaaaagagctgagggaacctgagtgaggtttggctatagacagaacctctgagtgagcccatcaaagttactttatttatttgtttgtttattaatttatttaagacagagtctcactctgtcgcccaggctggagtacagtggtgctatctcggctcactgcaaactctgcctcctaggttcaagcaattctcgtgcctcagcctcccgaggagctgggattacaggcacatgccaccacacccagctaagttttgtgtttttagtagggacagggttttgccatgttggacaggctggtcttgaactcctgacctcaggctaattttttgtttgtttttattctctttttttttttttttgagactgagtttcgctcttgttggccaggctggagtgcaatggcgcgatattgactcactgcaacctctgcctcctgggttcaagcgattctcctgcctcagcctcccgagtagctgggactacaggcgcacaccaccatgcccggctaatttttgtatttttaggagagacggggtttcataatattggtcaggctggtctcaaactcctgatctcaggtgattcgcctgcctcagcctcccaaagtgctgggattacaggcgtgagccaccgcgcccagccttttgtttgtttttaaatttaactttttttttgagaccgaattgcactctgtcacccaggatggattgcaatggcgcaatctcagctcattgcaacctctgcctcctgggttcaagagattctcctgcctcagcctcccaagtagctgggattacaggcgcctgccaccacagctggttaatttttgtgtttttagtagagatgaggttttgccatgttggacaggctggtcttgaactcctgacctcaggtgatcaacccaccttggcctcccaaagtgctgggattacgggcatgagccaccatgcccggccttaacttttatcttaagttcaggggtacatgtgcaggtttattatataggtaaacttgtgtcatgggggttgtacacattatttagtcacccaggtattaagtttagtacccattagttatttttcctgatcctcttgagggaagagagagaccctctcatattgtttcatactcagaaaaggaaagagaagcgaaactaaaggcaggtagcctggtgcctaggaaccagaccggaaaccaaggaaccagacccgaaatcaggcctgggcgtgcctgacctaagcctggtagttaaaattcgacccctgacctagcaactgttgttatctatagattccagacattgtatggaaggacattgtgaaacctcccgttaggttctgtttcactctgaccaccggtgctcgcagcccctgtcacgtaccccctggcttgctcaatcacgaccctctcacgcggacccccttagagttgtgagccgttaaaaaggacagaagttgagcacctgaagagctcggattttaagacgctagcctgccaatgctcccagctgattaaagccactcccttcactatcttggtgtctgaggggttttgtccacagctcgtcttgctacacttgccctcctccaaacttccgccctccaataggctccagtatgtgttattcccctctatgtgtccatgtgttctcatcatttagctcccacttataagtgagaacacgcggtatttggttttctgttcctgcgtttgtttgctaaggataatggcctccagcgccatccatgtccctgcaaagaacgtaatctcattcttttttgtggctgcatagtattccacggtgtatgtgtaccacactttctttgtccagtctagcattgatgggcatttaggttgaatcatgtctttcctatggtgaatagtgctgtgatgtgtctttataacagaatggtttacattcctttgggtatatacccagtaatgggattgctgggtggaatggtatttctggtttttggtctttgagaaattgctgcactgtcctccacgatggtttaactaatttacactcccaccaacagtgtataagtgatcctttttctttgcaacctcgccagatctcggtggtcaactcctcccactccccaggcaatgctgatttgctctgtgcctatagttttgcctttcccaggatgctgcgggaatgggatcatacggccttttggatctggctccttttagttagactgatacatttgagacaggtccctattgttgtgtgtatcagtagttggtttcttctttttttgagatggattctcagtctgtggtccaggctggagtgcagcggcatgacctcagctcactgcaaactccgcctccctggttcaagtgattatcctgcctcagcctcccaagtagctgggattacaggcacatgccaccacgcccggctagtttttgtattttttcgtagagatgggatttcaccatgttggagaggctggtcttgaactcctgacctcgtgatctgcccaccttggcctcccaaagtgctggaattacggcgtgagccatggtgcccagcctgcatcacaggttgtttacccaatactcaccagttgcagaattcaaatccattttttaaaaaatcagcctgaaaaaaaaagaaaaaaatcagtctggccaggcacggtggctcacgcctgtaatcccagcactttgggaggccaaggcgggaggatcacctgaggtcaggagtttgagagcagcctggccaaaatggcaaaaccctgtctctactaaaaatacaaaaattagctgggcgtggtggcgggcacctgtaatcccagctacttgggaggctgaggcagaagaatccctggaacccgcgggacggaggttgcagtgaggtgacatcaggccacttcactccagcctgggcaaaagagtgaagctctgcatcaaaaaaaaaaaaaaaaaaaaaaaaaaaaaatcagggtgggcacagtggctcactcctgtaatcccaggactttgagaggctgaggtgcgaggattgcttaagcctgggagttcaagacgaggctggggaatatagtgagacccccatctctacaacaaaaaatatacaaaaattagccgggcatggttggtgtgcgcctgtagtcccagttccttgggaagctgaggcgagaggattgcttaagcctgggcagttgaggctgcagtgagccatgatcgtgccactgcactgcacctagtttgaatggagtgggagtgggggattaggctctcctccctgccgtttgctcccaggccttttccgtagctggatgtgaccaacagagacagtgcccagcctcagtatagctagctcttagtggagggacaggagccatctggggcagatgtgggagagaatgtggcgaaggagagccgggtgcagtcaaggaggcttgtggctcggaggggaggtggggtgagtgagtggagactcagcagcttggctttggggaagtagacaagagagggccctctttggagagcggagcaagccaggatgtctggccttcacttccacttggaacagaagtgtgctgtgtgcgcgtgcttgtgcgtgtgcgtgcacgtgtgtgcgcgctaaatcaaacaccctcgctggctctgtgttcccctcaaggggaagccaactccacggatggcgggggtccattaggctgcaggtcttctccctgccgatagatggcgctgttgcaccgcgcctgggtttgcctctgcccgcagccatgcagggcccatcacgggctatgcctaccgcgcgaggggccttcaccatgtccactatccttatttatttatttatttatttatttatttattttttaagtgtgggtactggccgggcgcggtggctcacgcctgtaatcccagcactttgggaggccgaggcgggcggatcacgaagtcaggagattgagaccatcccagctaacacggtgaaaccccgtctctactaaaaacacaaaaaaattagccaggcgtggtggtgggcgcctgtagtcccagctactcgggaggctggggcaggagaatggcgtgaacccgggaggcggagcttgccgtgagccgagatcgcgccactgcaacagaacgagactatctccaaaaaaaaaaaaaaagtgtgggtatatagtaggtgtatatatttatggggtgcacattgataaaggcatgcaatgcataataatcacatcatgggctagatgcggtggctgacgccgagatcgcgcctctgcagtcgccaggccactgcaggcgccacagtggcgacagagcgagactccgtctcaaaaaaacaaataaataaataaatcaggttaggccgggcgcagtggctcacgcctgtaatcccagcacttgggaggcggaggcgggcgaatcacgaggtcaggagttccagaccagcctggccaacatggtgaaaccccgtctatactaaaaatacaaaatttagccgggtatggtggcaggcgcctgtaaccccagccactcgggaggctgaggcaggcgaatcgcttgaatccggaaggcggaggttgaagcgagccgagatcactccattgcactccagcctgggcaacaagagtgagattctgtctcaaaaaaaaaaaaaaaaaattacatcatagagaatggggtgtccatcccctcaagcatttatcctttctgttacaatccaattgcattcttttagttatttcgaaatgtacagttattattgactgtagtcaccctgttgtgctagcaaatagtaggtcttattcattctttctattttttttgtacccattaaccttccccacctccccatcatccttttttttgttttgagacggagtcttgctctgtcacccaggctggagtgcagtggcacgatctcagctcacttcaacctctgcctcctgggttcaagcgattctcctgcttcagcctcccgagtggctaggattacaggcctgcgccactatacttggctcatttttttcggggttttgccatgttggccaggctggtcttgaactcctgacctcaggtgatccacctgcctcagcctcccaaagtgctgggattacaagcatgagccactgtacccagccccatcatcctcattttatttattttttatttttattactatttttttaggtggagtcttgctctgtcacccaggctggagtgcagtggcgtgacctcggctcactgcaacctctgcttcccgggttcaagcaattctcttgcctcagcctcccgagtagctgggattgcaggcgcctgccaccacgcccggctaatttttgtatttttagtagagacaggagggttttaccattttggctaggctggtctcaaactcctgacctcaggtgatcctcccgccttggcctcccaaagtgctgggattacaggcgtgagccaccgcgcctggccagactgattttttttttaagtgaatttgaaagctgcaactggtgagtattggataaacaaactgtgatgggattgcaggtgtccacccccaagcctggctaatttttgtatttttagtagagaccatgttggccaggctggccttgaacccctgacctcaagtgatctgcctgccccagcctcccaaagtgtttgggattacagtcgtgagccaccgcacccggtcagaagtttaatttttttttttgagacggagtcttactctgtcaccccggctggagtgcagtggcctgatctcggctcactgcaagctccacctcccaggttcacgccattctcctgcctcagcctctggagtcgctgggactacaggcgcccgccaccaagcctggctaattttttcgtatttttagtagagacggggtttcaccatattagccagaatggtctcgatctcctgacctcgtgatccgcccgcctcggcctctcaaagtactgggattacaggcgtgagccaccgcgcccggcccagaagtttaaatttaactaggtgcccagtgatctcatcaagcccacagcactccctcaccctcgcccccacaacctcccttccccccacgccccccttcctcaccgcagtcccccccctgggacccctagatcttgaggctgatgggccagttcccagtttcactggttgttaaatattttgacagtgacccctgacagcaggagaggcagccaaactcaacagctgttctctcttccccccaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggtgctggtcctgcctgtccctggtccaaccccaccctcagcacacccctcccctcccctcccctctccagagcctccagccatgaccgggtgaacagccatggcctggagtcagcaacacaagactcttcccacctcagctcctccatctgagctgggctcagttgagctcatccagctaagctaaaggggagctgggcctgcttttctttttctggagatggggcctcagtctctccagtagctggatatacaggcatgctccaccccactggctaatttttgctttttttttttttttttttttttgagatggagtctcactctttcacccaggctggagtgaagtgatgcaatctcggctcactggaacctctgcctcctgggttcaagcaattctcctgcctccgcctcccgagtagctgggattacaggcgccagccaccatgcccggctaatttttgtattttttagtagagacagggattcaccatgttggccagactggtctcaaactcctgacctcaggtgatccacccacctcggcctcccaaagtgctgggattacaggagtgagccactgcacccagctgccttttttttttttttttttttttttgagatggggtctcactatgttgcccaggctggtctcaaacttctggactcaagtgatcctcccaccttggccacccaaagtgctgggattataggcataagccaccatgcctggttttggaattggttctttatctttgttctgctgctgcgtggcgtgatgttcaagagcaaaggacaacacaggggaagccagtgtcactggcaccacagccttgagcccatctctctagccctctgcaccttatttcccatctgtgaaatgcccttaaacaccccttctaattttaatattctgagtcaaattgagctcaggtccaaatgccaaatattgctgatattcatccactttttgacccacaaaagtggtcattttaacctacaataaaacatcctggctcagtggctcatacctgtaatcccagcactttgggaggcccagttggggggattacttaagtccaggagtctgagaccagcctgggccatatagcaagattctgtctctacaaaaaattaaaaaattagccatgcttgtgggcaagcccctgtagtcccagccacttgggaggctgaggtgggaggatcacttgatcccaggaggtggaggctgcagtgaactatgactgcactgaactccagcctgggcgacagagcgggaccctgactcaaaaacaaaacagtggccaggtgcggtggctcacgcctgtaatcccagcactttgggaggctgagatgggtggatcacgaggtcatgagttagagaccatcctggccaccatggtgaaacgtcgtctctattaaaaatacaaaaattagctgggcatggtggcacgcacctgtagtcccagctactcgggagactgaggtgggagaatcacttgatcccaggaggtagaggctgcagtgagctatcattgcaccactgcactccagcctgggcgacaggttgagaccctgtctcaaaaacaaaacaaagcaaaaacaaccccaaagtctggtttccttattaaccccaagttcatggtccacccgaagcttttcaaatgtcagtcccggctccccgcgccccagctgcagtgctgggccctatcgtcaccctcgccctcccggctccctgcgccccagtgccaggtgctgggcccagtcctcacccttgtcctcccggctgcccagcaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggtaaggtgggctctgcctccggggagggatctgtggtgggctcttacctccccttggcttgtgtcccgcaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaagaaagagagaaagagagagggagggagggagggagggaaaggaaggatggaaagaaaggaagaaaggcaggcaaaagccccagacaggccaaaaccttcatccttcatgcacccaacctgtaccaaacaccagcatggcctggctgtgagtgcacagcagatggaggtttgctgggcagagacactgggctggcctagacactgcctttggtgataccctaaaccaaaggggccagtcccacagtaagaaggagaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttctttaatccggtgcctgaggagttttgtctgtggctcgtcctgctacaagaggacacagcccagaggtgccacctgcagctgccctgtcccctctaatcccagctccaccctgcctgctcccgtccttcctccagggggaacatggacacgctcagatgaaccccagcttcttatgcctgaactggggaaactgaagccccatgggaccaggggttccactgggcatcaagggaggaaagttgagccccggggtgatctgggaactgggatctgggatctgggcaggcattggggcctgacagagcagaagtgaggagagggtaccaggagctgcaaactcggtgcctccaggacctattcggataaaataaatgggtggaactggaataagacaaagtgggggtgcgctgtggccaactggaaaatgctcgttgcagccacagcgttccattaaaaaagcgaaaggaacctgcctgcctgagtcttaagctccccctaaacccagaaatgggttagccctccagtatcctccagctctgagagctggggcgggcactccattactgggggaacaggaaatggatcctgggcactctagggcaacacacgccctccttgcagggaaatggatttccaggcaggggagatgcatgggcagaggtggcttggattgtttgctgtaagatttgaagctgtgatcaggaggtggctaggagatgggctgggtccagaccacaaaatggtagatcggaggatttggactctgtctcatgagtgagctggaaatcaagctggaaaatcagataagcttattcgcagcttcaatccagtccgttgcagaaggatgcatttgagggggctagagcagctgcagggaggccaggaggagctgtggaagaggacttgagtgtgggtcatggccatggggtttggagagaagtgatacagtgtcttcagagcttcagaaggcagagggagttcgatggctcaaggcagttggaagagttgggtgtgactgagggggtggggaaatggggcatgcgtggcaggcaaggactcttatgcatcacctcccagtcccttgtccatctggctacacttcctctttgcctggccagcctaggaccaagctgggatcatttccccaggatgccccacagacaatggcaaatgtgcccatcatagcagtttgtttaatgaaaatgatatgctgttgtgagtacgggatgtgccagcaatgctggctactgcatgagacgggagctagcagggagcaccttcatccagggtgtgcaggtccccttccctcagttaatgctcgtgggggcgggcgttagcctctccacttaccgaagaggagactgaggctttataaagttaagagagctgcttagggtcactcatcaataaagtggtggaggccagtcatggtggctcacacctgtaatctcagcactttgggaggctgaggcaggaggatcacttgagcccaggagttcaagaccagcctgggcaacatagtgagactcaatttctatttttaaaaaattatccagctgtggtggtgcacacctgtagtcccagctactcaggagactggggtgagaggatcgcttaagcctgggcagttgaggctgcagtgagctgtgactgcaccactgcactccagcctgggtgacagaggccctgtctcaaacaaaaataaataaataaataaatatataaagtggtggagcagtttgaattgtgtcattcactcattcaatatttaactgagcatctactgtgtgccaggcactattctagacaatgaacatacaacgagtaaacagataaaaatctctgtcctcagggagtctgtatgttggggttggggtgggggcggggaagaatagacaatgaaaaaatacttaaggaaaatatgtagacaccaattgtcctgatggccacccctgatggccaccagagggcactgcaaccacgcggccctccgttcgtctctaattccagctccctttccggattccgaaggcaatagccaaggaggctatgaatacgcagcatagcatctgctcaagaatcaacgcgaggaggcattggcagcagttttttctccacccacttttccagcctcatcccctcatcagacccccatccaactgcccagggtacccctgtgacttttcaaagccccgtgtactccagattcaccagctactcacattcactcccagccacccatcccctcccaaatactgtctgggttacccaccaaccccatccatccgctcacctgatgcctgtcctcctcctcacccacccacccgcgcccctcgccccttccacctgctgtcctgcccaccggaaactggccaaattgtcccatagatttttttttttttttttttttttttggataaacacagaaattgacattcctggtcttaaagcttgaaacttaaatttgccttatctgagttccttccccaggaaactgaccctcaggcctcccagatagcatcaaggaactgaaactccttttctttacccccctctaattcctgttttcccacccacagctacatttgctccccactatataaacccccaattggagtttgttggagagatggatttgagacttatctcctgtctccttggcagatgtcatctgaataaagccttctttcctggcgatactcattgtcccgggatcccagatcagctttctgtgcagtaagcaatgggacctagactgaatccctggcgtttcggtaatacacccatccatcctgtccacccccacccatcctgtccacccccatctatcctgtccacccccgacccatcctgtccacccccgacccatcctatccacccccttgtgcttccatccactcatcactcttcccacccctccgcccacccaccatccgatgctacagaagcccagaactggggcactcaatctagaggtcaaagatggcaagaggtcaaaccagattgacagtgagtcacctcagtggatatgagttttagtgtgctgaggccgtgaaaggtaaaagcatttaaaaacagcaaggccaggcacggtggctcacgcctgtaatcccagcactctgggaggccaaggcaggtggatcacctgaggtcaggagttcaaagctagcctgaccaacatggggaaatcccttctctactaaaaatacaaacttagctgggcgtggtggcatgtgcctgtagtaccagctactgctacttgggaggctgaggcaggagaatcgctgaacccgggaggcggaggtttccatgagccgagatcacaccactgcactccaccccggggaacaagatcgaaactctgtctcaaaaaacaaaaacaaaaaacccacaaaaattagccaggcgtagtggcgggtgcctgtaacccagctacgcaggaagctgaggcacaagaatcacttgaacctcaaaggcagaggttgcagtgagccgagatcatgccactgcactccagcctgggcgacagagtgagactctgtcccaaaaaaaacccagagcaaacaaacaaaaaacacaacggcgagacattcttagcaaaccaactatctgcaaacaattcaacgtcggatctttaaaaaaatcccgctgtggcattatgctgcggacacatacattaatttatggctagcccttcaagacaaccaggtgggtaaaattatgtaaatgttcaccgcctctatactttgttccaatgacttcctgagtaattgattgttttgccaattactcagcaacatttaagacctgcttccggaggccctaagtagctcagcattctaagaccgaagtactgaagaaaatctgcctgtgtggctgtgaataacatctccatccgtcactgtgcacatcagatttaggccagataacgcaggctttatttatttcaggtacgccttgcgcttcagatcatgggactctagtatagcacccccagaaaattatcaagggcaaaaaaatcataatacatacctctagttcagtgggtccttggataacctctttcctctctcctagttcttcagctaaaagattcaggagccttagcaacaagaaggagctatcccacaagttgcattattctagatattcggacacttttttttttttttaagcaggagtcttgctatgttgcacaggctggtcctgaactcctgtccttaagtgattctcttgccttggccttccaagtaactgggattacagcggtgagccaccgtgccagggttttggatgctttttttttttttttttgagacagagtctctcttgtcgccctggctggagtgcaatggtgtgatcttggctcactgcaacctctgcctcccgggttcaaacaattcttctcccttggcctcccaagtagctgggattacaggtgcgtgccactacactcagctaatttttgtatttctagtagagatggggttttaccatgttggccaggctggtctcgtactcctgatctcaggtgatccgcccaccacagcctcccaaagtactggggttacaagcgtgagccatcgcgcctggccggatactttttaaccaaaggaaaaagcaagcatctttattggaataatatatcaatatatgcaggtaatcagacaataccagtcagacaacactgacttctttttttttttttttgagaaaggaaggaaggaaggcagaaaggaaggaaggaaggagggaaggccggaggtggtggctcatacttataatcccagcactttttgaagcccagaagggagatcacttgaggccaggagtttgagaccagcctgggcaatatagagagaccccatcttgacaaaaaatttaaaaattagccaggcatgataatttgcacctgtagttccagctacccaggaggctgaggcaggagaattgctggagcccaggagtttgaggctgcaaccagccgtgactgcaccactgcactccagcctgggcgacagagagataccctgtctcgaaaataataaataaaggccgagtgtggtggctcacacctgtcatcccagcactttgggaggccgaggcaggcagatcacctgaagtcaggacttcaagaccagcctggccataatggtgaaaccccgtctctactaaaaatacaaaaattagccaggcatgatggcaggcgcctgtaatcccagctacttgggaggccaagacaggagaatcgcttgaacccgggaggcggaggttgcagtgagccaaggtcgtgccattgcactccagcctggagaacaacagcgagacttcgtctcaaaataataataaataaataaataaataaatatgtaaaaagtcccttaactgaggccaggcgcagtggctcatgcctgtaatcccaacacttcgggaagccaaggagggtggatcacctgaggtcaggagttcaagaccagcctgaccaacatggagaaaccccatctctactaaaaatacaaaattagctgggtgtggtggcgcatgcctgtaatcccagctactcaggaggctgagagaggagaatcgcttgaaccctggaggtggaggttgctgtgagccaagatcacaccattgcactccagcctgggcaacaagagcaaaacttcatctcaaaaaagccccttaactataatctaagaaacaaaaaatatttaatttttattttctgcatgatctgcttagttttcttaataagctgtgaaccagaaagggaatttgctgcggtttggcagccttttaggtggaggattatagtgaatacatttttagattattggtatagtaacttccccaaaggatgtaagattttgaggactaaaccaagtcctgcactttccattccaacctaattaattccagtgaatgaaacattcattggggaaagcacagaagatgcagaagagctgcttacatgacctgagtcaacaattcagtgaccctctgcgtataataatcaaaatagggccaggcgcagtggctcacacctgtaatcccagcactttgggaggccgaggagggcagatcacctgaggtcaggaatttgagaccagcctggtgaaaatggtgaaaccccgtttctactaaaaatacaaacaattagctaggcgtagtggcgcacacctgtaatcccggctactcgagaggctgaggcaggagaatcgcttgaacccaggaggcagaggtcgcagtgagtcgagatcgcgccattgcactccagcttgggcaccaagagtgaaactcggtctcaaaaaaataaataaataaaaataaaaatagaacaataaagtccattcataaattttctagcatagttaacttatccacctcctcttgcttttcgttaattaatttagttatcagagtacaaaatgaaaaagtaaaaaatatccattcactctcattcccatgaggtaaccacgtttaaggagctctgtgtttttagtcctcctggcatctacacttgagtggaaaagatgatcatttgtggttttaagcactattgactccctgatgtgaagaacaaagaatgtatctcactcattctttttttcttctttttttttgtgctgtttttattggtagtcttcctactagttatcatcataactttaaatgatatatttaatccccttttcttgaagcattgtttttatttttatttttttacttgtatttatttatttattgagacagagtctcactgtgtcacccaggctggagggcagaggtgtgatcttggctcactgcaacctccgcctcctgggttcaggcagttctcccccttcagcctcccgagtagctgggattacaggcacccgccaccatgcccaactaatttttgtatttttagtagaggtggggtttcatcatgtcggccaggctagtttcaaactcctgatctcaaatgatccacccaccttggccttccaaagtgctgggactggccggggatgatggctcacgcctgtaatcccagcactttgggaggctgaggcgggtggaaatcacaaggtcaggagatccagaccatcctggctaacacggtgaaaccccttctctactaaaaatacaaaaaattagccaggcgtggtggtgcatgcctgtaatcccaggtacttgggaggctgatgcaggagaatcgcttgaacctggaaggcggaggttgcagtgagccgagatggtgccactgtactccagcctggacgacagagtgagactccatctcaaaaaaaaaaaaagcaaaaaactccacaaagtgctgggattacaggcgtgagccactgcgcctggcctgaagcatcgtttttaaaattcagatataatttacatcgcatatacttcactgctttaaagggttcaggctgggcacagtggttgacacttgtaatcccagccctttgagaggctgaggtgggggggatcactcaaggccaggaatttttgagaccagcctgggcaacatagtgagactcgctctctaccaaaaaatttaaaaatgagctgggcaagatggcacacacctgtggttccagctacttgggacgctgaggtaagaggattgcttgaggccagaagctcgaggcagcagcgagctgtgattgcaccactgcactccaacctgggaaacagagtaagaccccttctttttttttttttagatggagtctcgctctgtcgcccaggctggagtgcaatggcgcagtctaggctcactgcaacctccacctcccaggttcaagcgattctcctgcctcagcctcctgagtagctgggactataggcgcccaccaccacgcccagctaattttttgtattttcagtagagacggggtttcaccacattggccaggctggtctcgaactgctgacctcatgatctgcctgcctcagcctcccaaagtgttgggattacaggcatgagccaccactcctggccaaaaccccttcttaaaaaaaaaaaaaaaaaaaaaaaaaaagaacatccttttttttttttttttttttgagacagagtttcgctctcttgcccaggctggagtgcagtggcgcaatctcggctcacctcctgggttcacgccattctcctgcctccatctcccgagtagctgggactacaggcacctgccaccacgcctggctaattttttttgtatttttagtagagatggggtttcaccgtgttagccaggatggtgtcgatctcctgacctcgtgatccgcacgcctcggcctcccaaagtgctggaattacaggcgtaagccaccgttcccggccaaaagaacatcttaataatcccagaaagattgggcgcagtggctcatgcctgtaatcccaacactttgggaggttgaggcaggtggaccacgaggtcaggtgttcgagactagcctgaccaacacggtaaaaccccatctctactgaaaacacaaaaattagccaggcatggtgatgcatgcctgtaattccagctactcaggaggctgaggcaggagaattgcttgaacctgggaggcggaggttacagtgagctgagactgtgccattgcactccagccagggtgacagagtgagactctgtctcaaaataaataaataaataaataaataaataaataaataaaataactccagaaagaaactcccttcttgtgatatcaagtacatctccctcctctcagccaatggcaaccattattctactttctgtcttgatggattttatctacatagaattgagggaagagagaacttctcatattgttttatattgttttatactcagtacctgttttaagaaaaaacaacaagaaagtaaaatcaaagacaggcagcccggcgccaggcccgaaaccaggcctgggcctgcctggcctaaacccagtagttaaaaatcaactcataacttagaaaccaatgttattcatagattgcagacactgtatagaagaacactgtgaaactccctgccctgttctgtttctctctgaccaccggtgcatgcagcccctgccacataccgcctgcttgctcaaatcaatcacgaccctttcatgtgaaatctttagtgttgtgagcccttaaaagggacagaaattgtgcattctgggagctcggattttaaggcagttgcttgctgatgctcccagctgaataaagcctttccttctacaacttggtgtctgagaggttttgtctgcggctcgttctgctacagaagcatacaacacatggccttttgtgcctggcttcttccattcagcatgtttctgagggtcatccatgttgtctgtacttcattccttttaatggtttccattgcatggatatactacattttctttacccatgcttcagttgatggacatgtgggttgtttctacgttttggctattatgaattatgctgctatgaaaattcatgtactggttttggtgtgggcacacgttttcaatttctcttgggtgtatacctaggaatagaattagaaaatcatgttggctgggtgcggtggctcacgcccgtaatcccagcactttgggaggccaaggcgggcggatcacgaggtcaggagatagagaccatcctggctaacacggtgaaaccccgtctctactaaaaatacaaaaaattagccaggcgtggtggtaggcgcctgtagtcccagctactcgggagactgaggcaggagaatggagtgaacccgggaggcggagcttgcagtgagcagagattgcgccactgcactccagcctgggcaacagagcgagactccgtctcaaaaaaaaaagtcatgttttactttttgtggaactgccacactggttttcaaagctgctgcttgtacattccactagcaatgcacaagggttcctatgtctccacatccttgtcaacacttgttattgtccatctttttaattatagccatcctagtgagtgtgatgcagtacctaattgtggttttgatctgtattttcctaatgattgatgatgttgaacatcttttcatgtacttatagaagttattaaaaaattactttaggcagatggagaggaaaaggggtccttggaaagttgtttcttttaaagcaactccagaaacgtttctggtttaccaggaaagccctggctcttagagcccagccagcaacatttgatatgcaaatgcagaccattagaaactgggtccacccaaacatggcgattcccaccgttgtcctcttgcccttgcccccacatgtgcctggcaaatggctacccctacatatcccccacctgtgtaaaacatcatggtgccctgcatttgcatcttaaaaggctagggtgagagggccagttttttcgtgggctatatgaatgacatgcctggttaaaccaatcccctaagccctatgcaaattagacaacacctcctccagcctcctcatatacccggttggtatgccccgcatttgtggtctcctctcttggctttggagcccccctccctctgtctctgtacgggggtgccttcttcttttcttcttctcccttctttcttgcctattaaactctccacttcttaataccactacacgtgtatctgtgtcattttatccaatttgcatgagacaagagccctggtgcccctccactcatcagagccgtatcattttggtgcatgggccaggaaaatccaaagtacagccttcgttggagtggtgagtatgggagcaatcctaaaatctgttctatcattacgaggcgctcttagcctctatattaaaataaatcaaacgggcgtccgtcagcctaatacataggcttagcattggctgccgtactaaagactcggatgtgaggcttgctggggagaacttggagaatcccccattacccacaggtactgggaattttggccatgtttgaactagcttctttttgttagggataacgctcaaaatcctaaggaaattgaacactcgaacaaaggattcttagcaaagcaattttacttctgcacagagggttgcctccttggccagttgccatgagagcacacctgaacaaaggggcatgagagcctttatttgcgatggaagtcctgcccctgtaccctttcctcattggctggggttgggtcatacaatctaaactaatcccggttggctaaacatttcattttttaagatagggtgggcacgtaaaaacaagtggagaggaaggggaaggggtgtctgtaatgagctagaaagttagtcatttttccaaataaggaaaggaatgtgagctggtactgataacgcttggtactgtggtgtgcctgggcatctaacaaaggcaaaatggaaaaggagaaagaaggagaaaaaagggggggggtacaatgaattaaagaatgaaagattgatgagattatttgaagagaaacctcatcatattccacattttcacagggagaccttgccatcatgcgaggctgggaaaacttctgaggtaactgagaatttctggtcagggcacactctggcatgattcaagggcctctggaccggacgcagcctccgacagccgggtgttggcagagaatcctcaactatcctgtggccaaattttctttctgtctctatccatggtctcttaccctctctgtgtgtctaatgtgcagggatctttacagttcagggaaacaggtctgctagaagagatggtgaatcacggcagccagtaactcaataaacgtttctctatggtttctctggtgagcacgtggtatttctaagccacctagtggcaataaaaatcctcttcatgagacacattgctggttctctacggtacattgcagcttcgcaatttttctattttgcgcttttttactgctatttctgtgaacgggaaggctctgcttttaacaggagtcaaatgtcttctgcagccagattttagtcctaatattgtcccatcagtagaaattggccatttgcttcctacgttcttttaaggcacctattctgtctccagttaagatagtacttaattagtagggaaattttaagtctggaagttaaccggaaccattttcctatgggtaaatgttttatcataggccataatagcaggatttagagttcaatctagcatgccccctgccttaaaggggtcttgcccaattacatgatttttcttgaaatccatttttttaggaaggcacaaaggccacacaagtctggaaggtcaaagagaaataaaaggcagaggactaaggctgcttggggaaagcgtgactaaggctcaaaagttgagttcctctgatgtcatggcttggagggtcacgcctgcagtcacaggtcactggtggcccatttaaataggtgctgggaatccagaaaccacggagagaagatagttgggggaactccccctactgcttttgtctccaacctggatcacataccaaaaggaaggagactaaaagaacgcttttattctcacttctctttctagatgggaattagatcatgtataacatgcactgccctcgagtgtattttaaagcactgggactccttcaactctgaaactttgaagaaaaagtggcttattttcttttacacaagggcatggcgtatttgtttttgttttttttttgttttttttgtttttttttttttgagacggagtcctgctccgtcactcaggctggagtgcagtggctcgatttcggctcactgcaagctccacctcccgggttcacaccattctcatgcctcagcctcccgagtagctgggactacaggcgcccgccaccacgcccggctaactttttttgtatatttaatagagacggggtttcactgtgttagccgggatggtctcaatctcctgacctcgtgatccacccatctaggcctcccaaagtgctgggattacaggcctgagccactgcccccggctgggcgtggcctttttactaaacttctgcaagcgttgcaaaatcaacctagctcttttagcaatcacatcaggcaggcccaaagagaatgattacccaaaattagagaagccagttctaggggaaccacctgaggattcctttatttggggccccttcaagttcctttctcattatttaggaccttaggcaagtaaagggagacttaggccaattttctttctttctttatttttttttgaaacatagttttgctcttgttgcccaggctagagtgcaatggcgtgatcttgactcactgcaacctccacctcccgggttcaagcaattctcctgcctcagtctcccaagtagctaggattcacaggcgtgcatcaccatgcccagctaattttatgtttgtttgtttttttagtagagacagtttcaccatgttggtttggctggtcttgaactcctgacctcagatgatccacccgcctcagcctcccaaagtgctgggattacaggcgtgagccactgcgcctgtccaatcttctaatgaccctgataggtatacagaagttttccacaatttaactcaggtatttaacctctcatggaggaatgttatgctgctcttaagccaaaccctaactgcagttaaaacaggcagctctgcaagcagaagaaaattttggagataagcaataggtctcctatagtaggccaaaagggaaaagaaaaaatagggaaggcaaagaaataggggaaacaatatttccaataggaaaagaggcaatacctcttggcaaccctatttgtcactcctttctatggtgtttttccttctttcacggtttaaaatggcttctatctcttttataatgttcttccaacctgggaaaagttatttttccaaacgttaaaatgcttggcttagagttgagctagggggaagggaacacagaagcctggtatgctggcaaaagggtaaacatttcttaccagatgggcttttggcttctccctgtgcaaaccggtaaaagggataataaggatcattgtttatattctctgtaaatttctaattcataaaaaaggatttgtgaggttggtcttaagctgtaaacaatctggtgtgctttgcatgtctttccctaagaaagggtatcttaggttaggatgcaggcctaggaccccataagcctggtgtttgagcgagcccaacaaaatcgtcactaacaaaattggctataagccttcatcttgtttcatgtccttggaaacatgacctgtaaccacgtggcaatactttgtttgagtctccaccatttcataatggtggctgtcttctggtgctaagtcagtttctgggtgagggccacaaaatcagattaagtcggtttgtcaatctgggtggtgccagctgatccatcaagggcagggtttacaaaatatcttaaacactcattttaagagtagtttagggagtgtcaaaatcttgtagcctccagatgcatagctcctaagccatagtttccaatatatatatataattttatattatatatatacataattttatattatatatattaatatataatatatataattatatatgttaatatatttaatatataattatataaaatatataatatataattatatatgttaatatatttaatatataattatataaaatatattaatatatataattatatagttaatatatttaatatataattatataaaatatataattatatataattatataaaatatataaatatatataattatataaaatatataattatatataattatataaaatatataattatatataattatataaaatatataattatatataattatataaaatatataaatatatataattatataaaatatataaatatataattatataaaatatataaatatataattatataaaatatataaatatataattatataaaatatataaatatataattatataaaatatataaatatatataattatatataattatataaaatatataaatatatataattatataaaatatataaatatatatatatatatattttttttttgagatggagtcttgcactgttgcccagggtggagtgcagtggcgcaatctcagcttgctgcaacctccacctcccaggttcaagtgattctctttgcctcagcctcacaagtagctgggattacaggcgtgtaccactacacctggctaacttttgtattttcagtaaagacagggtttcactatgttgaccaggctggtttcgaactcctgacctcgtgattcgcccaccttggcctcccaaagtgctgggattacaggcgtgagccaccacgcccagcctggtttttaatcttatggctagtttcttggtctggtccccagacaagagggaagtatatcttaagaaggggctgatatcatctttgttttaaactatctatagtttaataactataaactatctatagtttaataactataaactatagcttaataactataaactatagtttaataactataaactatagtttaataactataaactagtttaataactataaactatagtttaataactataaactatctatagtttaataactataaactatctatagtttaataactataaactatctatagtttaataactataaactatagtttaataactgtagttttaaactatctatagtttaataactataaactgtctatagtttaataactgtaaactcgcccctcccaaagttggtccagcctacacccagggatgggcaaggacagcttgggggctggaaacaaaatggagttgtttgggtcggatctcttctctttcactgtctcagtctcagttttgcaatgacagtttcaaaagctgcctattactcctttgaaaataccttgtacacttgtggataagtcataacctaattaaggctcattgggttcacctgtgaggttactttttgtaaaactcaaaagccaaaaatcttaactgcttggcatggctaaagtcaagtaacaagggattttgaaggcttttcttagagcactcagcttaattaaaagtggatattcaagttataggtatacttaaaaggcctttatgtttttctcttcttgaatcttgttttctggaaaaaggctcttctcagtcaactgaattatttttctccatttttgtcttaaccactcttaatgcatgcatgagagtccctaagacaacttctgacagcatggaactccttgggaaaaacagaggaggtgccacaaaccctgttttggaaaaaaaacctgttttcctcatgaaacccccaaaattaaaagctgatagttccctctcaaaaccaaaggctctgttctgttatgtattgtgttatctaccgttttgagttttgggggtatcaaattacttcacattataaaagagctttgatgtgtaataactaggtagaaaatacactgtaaaggatgcctaatagtagttataaatcaaaaaagcatgctcttgggcacctaaaaaacatccccaccccccacaaagagatgagactaccatgcagaatgggctaattgccaaaataagccaattggctttgggttgccttgcaatgaaatgcatggtagaaacactacactgtcttctctcatagtatctatatggtcttttcataaattgagcattgaaataaaagcatagcaaggagttcctaaaacactaatctgtcctttggtaaaaaggttataaaagatttgtaaagatttaactgtaactgtcctggaaattttgtcattcgcaaacaattgttgtcttgcttcgttccttctcagaaaatggtttataatcaagctatattaaggactttaacaggtgttctcaaatgcaggtttttaatagctttgaagattgtaacattggaataaaaaagtacaggactcataaagaatggacatattcacaaatatcaagcaaaacaaaagttaactaaatggactgcactcaaaaagttaaagcagcttttttttttttttttgtgatagagtctcactctgtcacccaggctggagtgcaatggtgcaatcttggctcactgcaacctccgcctccctggttcaagggattctcctgcctcagcctgggattacaggcgcccaccactgcgcttgacaaatttttgtatttttagtagagacagggtctcaaactcctgacctcatgatccacacgcctcagcctcccaaagtgctgggattacaggtgtgagctgccgcacctggccaaagcaacctttttaacttttgcttggaatattgcaaatacgcatgagagtccctaagataacttaaggatccttgttttgtctttcagagtcaagaaaacttattttgaactatttacagcctttaataattaagtaaggtgccgggcaccgtggctcatgcctgcaaacccagtactttaggaggctaaggagggtggatcacctgaggttgggagtttaagaccagcctgaccaacttggagaaaccccatctctactaaaaatacaaaattagctgggtgtggtggtgcatgcctgtaatcccagatactcgggaagctaaggcaggagaattgcttgaacccaggaggtggaggttgcagagccaagatcacaccattgcactccagcctggcaacaagagcgaaactctgtctcaaaataaaataaaataaataattgcgtaaggtatatgcctgtgaacaaaatttggagcatgtttgtttttctctgcctggttcctctagaacgtggagactatctgtgagtactcttaacttatggcagtaaggttgtttgcatcagtgcaataagagtcaattttctggccgggtgccgtggctcacgcctgtaatcctagcactttgggaggccgaggtgggcagatcacaaggtcaggagatcgagaccatcctggttaacacggtgaaaccccgtctctactaaaaatacaaaaaaattagccaggtgtggtggcggtgcctgtagtcccagctactcaggaggctgaggcaggagaatggcgtgaacccgggaggcggagcttgcagtgagccgagatcgtgccactgcactccagcctaggcaacagagcaagactccgtctcaaaaaaaaaaaaaaaagagtcaattttctttgtcaacaggacacagttggaaaaactggttattttaccaaggtttcactgaaagggtgtgtttccctttaaggaatcaagcttgacatgcagacccaataaaaaccccttggagagaactggcctcatagttagtctacacagtccccacacagggttcctaacctatggtcagtaaagagtgtcactttctaacaggcctgggagctccaagtttatcttggaaccttaagaggagaggatcacccaactcacaggtatttgaggatacaaacccatagttgggctcggctttaaaggtcttatctgaaattccttgtgcaacaaagtttcatcaaagccaattcaaaaggcctgtgtagaaataaccattcctggccgggcacggtggctcatgcctgtaatcgcagcactttgggaagccaagctgggcaggtggatcacctgaggttgggagttcgagaccagcctgaccaatatggagaaatcctggactcttctaaaaatacaaaattagctgagcgtggcagtgcatgtctgtgaccccagctactcgggaggctgaggcaagagaacagcttgaacctgggaggcagaggttgcggtgagccaagattgccctgttgcactccagcctgggcaaatcatcaggccaagtataaaactaaagtttattctacaaacaacacacatggtcctatcataatttgtttttaccaaaaatgagacctggagaaattgtgtcccaaagcttatcatacatttgtcattaaatcctagtctcattaattgtttttaagctttttgcctacattttagactaaccctgtttattcctgtaaatcaagtggtgatctgcagcttggaagaaaaaaaaaggaatggagaatgtaaaaatctgaatcaatatactggttctgggcaattatcctataaattctgccaggtaataaaagtgagtaggggccaggcgcggtggctcacccctgtaatcccagcactttgggaggccgaggtgggtggatgacctgaggtaggagtttcagaccagcctgggcaacatggtgaaaccccatctctactaaacatacaaaaaaattatctgggcatggtggtgtgtgcctataatcccagctactaggaaggctgaggcaggaggatagcttaaacacaggaggtggaggttgcagtgagccgagatcgcgctattgccctccagcctgggtgagaaggcgagactccgtctttaaaaaaaaaaaaaaagaaaagcagggcgcggtggctcacgcctgtaatcccagcactttgggaggccaaggcgggtggatcacgaggtcaggagatcgagaccatcctggctaacatggtgaaaccctgtctctactaaaaatacaaaaaaattagctgggcgtggtggcgggcacctgtagtcccagctacttgggaggctgaggcaggagaatggcgtgaacccaggaggtggagcttgcagtgagctgagatcgcgccacggcactccagcctgggcgaaagagcaagactccgtctcaaaaaaaaaaaaaagtgagtagggtgcccatagcttggagatttctttgtttgggaaaataaaacaaaagaacttcataaacccccaaagggaaattctatatcttggcaagtaaaattttaagtggaaattatctactacaccacacttgtgggaattgctgtactcaccccactattttcaatagggttatacacggtagcaccttaaagctgaaatattggacagagtttccattgccgtagtattctgcttattatccttatagcagggatagtagttactaacgaaaaggaagcataaaagttactatcaccgaatctgccaggactttttactgggtttagtgatgcacttttaaatgaaacatgctgcttctggattaaaacctctactaaagtagaggaaaatctacaggtacttaaagatgaaatcaaaatcattgacaggctcagagaaaatgccggcttcagccccgggtggctacaatccctctttaatgaattcctgtcttctttatggaattggttaacccctttattaagccctgtcttgtttatatgtcttgtataaatatttggaccctgtatactcaatactgtaactcaaattgtttcctcttgcttagaagccatctaactccaaatggtgcaaactgaacaacccaaggacatgcccccacatgtgcctggcaacgtggctgcccccacatatccccacctgtgtaaaacatcattgcaccctgcatttgcatattaaaaggctagggtgggagggccagttttttcaaaggctacacgaataaaatgcctggtcaaaccagttccctgagccctatgcaaatcagacaccgcctcctccagcctactcataactggctggtatcccccgcacttgtggtctcctctgttggctttggagcccctctccctctgtctctgtacaggggagcttcttccttctttctgctcccttttttcttgcctattaaactctccactccttaaaaccactccatgtgtgtccatgtggctttatccaattcccacggaacaggagccctggtgttcctccactcatagaagctttattacttatatatatattctatatatccatcatgcatcctacaaagtgaaagcaactttttttttttgagatggagtctcactatgtaacccaggctggagtgcaatggcacaatctcggctcactgcaacctctgcctcctaggttcaagtgattctcccacctcagcctcccgagtagctgggactacaggcgcatgcaaccacagccagctaaattttgtatttttagtagagatggggtttcaccatgttggccaggctggtctcgaactcccgacctcgtgatccacccacctcggcctcccaaagtgctgggattacaggtgtgagccacaaagcccggccaaagtaacttattaattctgataatttttccctccctccctccctccctcactttcttccttccttccttcgttttgttttggtttttgagatggagtcttgctctatcgcccaggctggagtgcagtggcatgatctcggctcactcaacctcttcctcccaggtgcaagcgattctcctgcctcagccacctgagtagacgggattacaggcgtgtgccaccacactcgtttttgtttgtttgtttgtttgtttgtttgttttttgagacagagtctcgctctgtctccccagctggagtgcagtggcacaatctaggctcactgccagctccacctcccgggttcaaatcattctcatgcctcagcctccccagtagctgggactacaggtgcccaccaccatgcccggctaatgttttgtatttttagtagagacaggatttcactgtgttagctaggatggtctcgatctcctgacctcgtgatccacccgcctcggcctcccaaagtgttggaattacaggcgtgagtcactgcgcccagcctacacacactttttttttttttttaattagctgggcctggctgagcacggtggctcatgcctgtaatcccagcactttgggaggccaaggcgggcggatcaactgaggttgggagttcaagaccagactgactaacatggagaaaccccgtctctgaaaatacaaaattagccgggcatggtggcgcatgcctgtaatcccagctactccagaggctgaggcaggagaatggcttgaacctgggaggcggaggttgctgtgagctgagatggcgccattgcactccagcctgggcaacaaaagtgaaactctgtctcaaaaaaaaaaaaaaaaaaattagctgtgcctgtagtcctagctactgtggaggctgaagcaggaggactggttgagcccagttcaaggacgcagtgagctatgattgcaccactgtactccagtctgggcaacagagtgagatgttatctaaaaaaacagagtacaattcagtggtttttagtatattcacaaagttgtgcaatctatgccactatccagacattttaatcaacccaaaacgaaactctatgccgaatagtcactgcccattcccctctcttccctagccctgccaaccactaatctgtagggaccagccccacagggtcggtgggtctctccctgtgtgcggcgacgagagagtgtagaaataaagacacagacaaagagataagagaaaaggcagctgggcccggggggaccactaccaccaatgcccggagaccggtagtggccccgaatgtctggctgcgctgttatttattggatacaaggcagaaggggcagggtaaagaatgtgagtcacctccaatgataggtaaggtcacgtgggtcatgtgtccaccggacagggggcccttccctgcctggcagccgaggcagagaaggagaggagacagagagaaagagagcttatgccattatttctgcatatcagggactatttgtattttcactaatttactactgctatctagaaggcagagccaggtgtacaggatggaacatgaaggcggactaggagtgtgaccactgaagcacagcatcacagggagacggttaggcctctggataactgcgggcgagcctgactaatgtcaggccctccacaagaggtggaggagcagagtcttttctaaactcccccggggaaagggagacccctccccccactttcccggtctgctaagtagtgggtgttttcccttgacacttacgctaccgatggaccacagtccgcctggcaacgggcgtctgtcttcccagacgctgtcgtcaccactagaccaaggagacctctggtggctctgtccgggcataacagaaggctcgcactcttgtcttctggtcacacttcgctatgtcccctcagctcctatctctgtatggcctggtttttcctaggctatgattatagagcgaagattattataatattggaataaaaagtaattgctacaaactaatgattaatgatattcatatataatcatatctaagatctatatctggtataactattcttgttttatattttattatactggaacagctcgtgtcctctgtctcttgcctcggcgcctgggtggcttgtcgcccacactaatccactctcttaacccccctccctttttttttttttttttaagagataggggtctcattataatgttgcctaggctggcttcaaactcctgggctcaagtgatcctcttgcctcaacctcccaactagctgacacacgccaccacatcaggctttttctttttttttttttttgggacagaatctcattctgttcacccaggctggagtgcagtgatggtgtgatctcggctgcaacctccacctcccaggttcaagcgattctcgtgcttcagcctcccaagtagctgggatcacaggcatgtgcgccaccatgcccggctaattttctgtttttagtagagacggggtttctccatgttggtcaggctggtctcgaactcctgacctcaggtgatccgcctaccttggcctcccaaagtgctgggattacaggtgtgagtcactgtgcctggcctaattcttgtatttttagtagagacaaggtttctccatgttgcccagactggtctcaaactcctggcctcaagtgatcagtccaccttggccttgcaaagtgcaggggttacaggcatgagccactgcactcggtctatttttttttttttttttttttttgtagagacaagggtcttgctgccaggcgcggtggctcacacctgtaatcccagcactttgggaggccgaggtgggtggatcacgaggtcaggagatcgagaccatcctggctaacacagtgaaaccccgtctctactaaaaaatacaaaaaattagccaggcgtggtggcaggcacctgtagtccccgctactggggaggctgaggcaggagaatggcgtgaacctgggaggccgagccagcagtgagccgagattgcaccactgtactccagcctgggcgacaaagtgagactccgtctccaaaaaaaaaaaaaaaaagaaaagaagagacaagggtcttgctatgtggcccaggctggtcttgaactcctcttatcttggcctcccagagcgctgggattacaaggatgagccaccgcacctagatgctggctactttaagattttcactttatcagtggctttgagcaatttgattatgatgtgctttggtgtagtttcttgtgttagagaattgttgagcttcttggatgtgtagatttatgattttcatcaaatttggaaactgttaagctattagtccttaaggtattttttctgtgcccctctatctctcctttccttcaactccaattactcacatattagcctgcataaagttattccacagctcactgatgtggttttctttttactttccagacagggtctcactctcacccaggctgcagtgccgtggcacaatcataactcactgcaaccttcacctcctaggctcaagaaatcctcccatctcagcctcctaagtagctgggactacgggtgcacaccatcacacctggctaattttttcttttttgtagatatggagtctagctatgttgcccaggttggtctcaaactcctggcctcaagtgatcttcatgccttgacctcccaaaatgttgggattacaggtgtgagctactgtgcccagccatgtttttcattcttaaaattgttttttctgcctggccctgtggctcacgcctataatcccagcacttcggggggctgaggtgggtggatcatttgaggtcaggtgttcaagaccagcctggccaacatggtgaaaccctgtctctactaaaaatacaaaaattagccgagtgtggtggcacatgcctataatcccagctacttgagaggctgggccaggagaatcgcttgaacccaggagtcagagattgcagtgagccgagaccttgcgccagtgcactccagcctgggagacaagagtgacactccgtcttaaaaaaaaattgtttttttttctgtgaggatcacttgagcccaggaggtcaaggctgcagtgagccgagatggtgccactgcaccccagccagagtgagaccctgtctcaaaaaaaaaaattgttttttctctgcgtttcattttggatttcttttgctatgatttcaacttcactaaggcttccttctgcaatatctaatctactatcaaccctatttattgtacttttcatctctgacattgtaatcttttagatgcttgacttgggcctttgttttgtatctccttatcgctacttaattttttaacatatggcattcagttatagtaactattttaatgttttctgctcattgtaacatttgtgtcagttctaggttggtttccattaactgattattcttcttaatatggtcatgttttctgcctctttgcctgcctggtaatcttttcttaaaagtggggagcttttaaaccaatctcatcttctgggttaaaaagaatttttttgccattgaagttcatcttcatattccaatttttaaaaagcattctataaattttaatcatgtacaattatggggtacaccatgctgttatgatatatagatacagcatagagtaattgaatcaagctaattaacacgtttatcatcttaaatactcatcattttttcctgtctagctgcaactttgtactctttgaccaaagtcactccgtttcctccccacctccagtttctgctaactaccattctactctctgcttctattagttcaattatttcagattacacatttaagtgagaacatgccagaatgcggtatttgtctttctgggcctagttcatttcactcagcataatgtcctccagcttcatccatgtagttgcaaatcacaggatttgcttcttgcttctttttaaagttgaatggtattctattcaaatgtgtatatatacacattttctttatcttttctgtcttttcatctcttttttttttttttttttttttttttgagacagagtcttgctctgtcacccaggctggagtgcagtgacttggtcttggctcactgcaacctccgcccctctgggttcaaccaattctcgtgcctcagcctcccaagtagctggaattacaggagtgcaccgtaccatgcccggctaatttttgtatttttattagagacagagtttcaccctgttggccagactggtctcaaactcctggcctcaggtgatctgcccgcctcagcctcccaaagtgctgggattatacacgtgagccaccacgtccagcctgttttttgtttgtttgttttttgtttttgagatggagtctcactctgtcagccaggctggaatgctgtggtgcaatctcggctcactgcagcctctgcctctcagcttcaagcgattctcttgcctcagcctcccaagtaactgggattacagacgcctgccaccatgcccagctaatttttgtatttttagtagagatgggggtttcaccatgttggtcaggctgctctcaaactccttacctcaagtaatctgcctgctttggtctcccaaagtgttgggattacaggcgtgagccacagcgcctggccacattttctttatcctttcatctgctgatggatgcttaggttgatgtcatgatttgcctgttgtaaataacactgcagtgaacctggaaatgcagatatctctgacacactgatttttcagttcctttggatatacacccagaagtgggattgctggatcatttggtaagtctacttttagttttttcgttttgttgttgttgttgttgttgttttaaatgagtctggctctatcacccaggctggagtgcagtggcactatcttggctcactgcaaacctccacctcttccctgctcatgcaatccttccacctcagcctccctagtagctggaactatggtgcatgccaccatgcctggctaatttttgtattttttgcagagacgggggttttaccatgatgtccaggctggtctcaaactcctgggctcaagtgatctgtccacttcagcctcccaaaagtgctgggattacagatgcaagccaccacgcccagcctatattttgaggaacttccatataattttccagaatgactgtaataatttacattcccacgaacggtgggtaagggttcccttttctccatatcttcaccaacaccagcaccaacaggtgatatctcatcgtgcttttaatttgcgttttcctggtggttagtgctgttgaacattttttcatatatttgttggtcatttctgtgtcttttttttttttaatatctgttcaggtcctttgcccattttaaatcagcttatttgtttttttcactctgagttttttgagtttcttatatattttgggtattaacaccttattggatgtattgcttacaaatgttttctcccaatctgtaagttattacttcattctgttaattttttccttatgcttggtaatccttgattgcttatcagacattgtaaattttaccttgtagaacaccaaatatttgtgtaatctttatgatttgttagacaggtccagattaatgctcagtgtaggcttaatttttttttttttttttttttttttagatagagtctcaccgttgcccaggctggagggcagttgtgccattttggtgcactgcagcctctgcctctggagttcaactgattctcctgcctcagcctcctgagtagctgggactagaggcacacgccaccatgcctggctaatttttgtatttttagtagagagtgggttacaccctgttggccaggctgctcttgaactcctggcctcaagtgatctgcccaccttggcctcccacagtgcgattacaggtgtgagccaccgtgcctgcccggcctttttaagagatgtggtcttgctgtgttgcctgggctggtctcaaagtcctgacctcaagtgatccacccatctcagcctcccacagtgctgggattacaggcatgagccactgcaccggaagtctaggtttaattattccccattactgagacaagatcttcctgagcactctaccccatgcctagcgaatgatcagtttttccagctggccagtgggaagaggtcctggccctacctcgtgtgaatcttgggcgttgtttcctcgaatcctttcagctggttctttccctggccttggagagtttcttcacacacatgtgctgattagttctttgctgaatcctctgaagtcctctggggtactctctctgtgcacctctgtcttgtaggtgttccattatctaagctctagctgctgtggtctcctcggactcagccactccatttcctcaactctgcgaatcctctgggctgcaacaacccacatcccccttgccctgccccacactttggaaacgctctcgaagcagtaaactgcacagtcctaaaaggactgttgatgtcctttctctctgggatttcattgcttttgttactttctctcattgcttgatgttcagcgttttgaacactgttgttccatgtattgggtctgtttttgtcactgtggtggtggtgattgtttcagacaggagggcggacccagcccacgtgactccatcttggctggaagcaggaatctcgggatcagtggtttcaaagctcctcaggtgattccaggggacgctgaggtgaggaccacttgcagagactcctctgcttgaaatatctctcaatcaaatggaatcttcttttgttgttcccaccccttcattttctctgttctctctttctgagttttttctttgtttttgttttttgagacaaggtcatgctgtgttgcccaggatggagtgcagtggtgccatcacggctcactgtagcctcaacctcccgggctcaaacaatcctcctgccccagcctcacgagcagctgggaccacaggcccataccatcacgtccagctatgttctctctttctggaacttctgttaaacaaatatggattgaattgattctccatctcttttctttcatattttcctttcttttctttcttttttgttggcattttgctctacatcctgagaggtgtttcaaaacttttccacccgtaccttcctttgattaattttttatttaacttaattaattaattaatttttgagacatggtctcactctgtcacccaggctggagtgcagtggtgcaatctcagctcactgcagactcaacctcctgggctcaagtgatcctcctacctcagcctcctgagtagctgggagtacagatgcactccaccatgcccggctaattattttattttttgtagagatggggttttgccatgtttcccaggctgtgatggatttttaaatttggtccgtcgtatttgtgacttccagaactttgtcttgttctccaattgcagcatcttcctggaagcctcttcttggttcgtggtgcattatcttattcattcctttcctccagggctagtgttctgctattcttcctttcttttttttttttgagacagagtcttgctctgttgcccaggctggagcacagtggcgtgatctcagctcactgcaagctccagctcctgggttcacgccattcttctgcctcagcctcccgagtagctgggactacaggtgcctgccactacgcccggctaatttttttgtattttcagtagacatggagtttcaccatgttagccaggatggtcttgatctcctgacctcatgatccacccgccttagccttccaaagtgctgggattacaggcatgagccattgcgcccaggctttttttttttttttttttttttttttgagatggagttttgctcttgttgcccaggctggagtgccacctgcagcccagtgatcttggctcactgcaacctctgcctcctaggttcacgcaattttcgtgcctcagcctcccgagtagctgggattacagtcatgtgccaccatgcccggctaattttatatttttactagagatggggtttcaccatgttggccaggctggtctcgaattccagacctcaggtgatccaccctcctcagcctcccagtaagccactgcacccaaccatctgctattcatcttaatcctctctggtggcaccgaaatgaagaggagacccatgtggatctccctgcagccgggtgagtctggttccacaggaggccttttcctgaactggctgcaggctccgcgggcaggtctgttaattggttaaaatgcttcattcagttaggtgggttttgttcccttctccccacccagaggacatttgggaatgtcgggagatatttttggttatggcagctagggggatccttctgacacctagtggatagaggccagaaatgccactaagtatcctaggacatgcaggagagcctctcaacgattaagaatcagctgtcccaacatgttaatagcacataggtcggagagacaccctgatttaaggccatctgagtacaggctccccagctctcaccaccaaaggccaagataaggagggtccctctacagccacttcagggaacttccaagggagcttgttcaattatgtttatttattttatttatttattttttttgagacggagtcttgctctgttgcccaggctggagtgcaacctccacctcccaggttcaaacgattctcctgcctcagcctcccaagtagctgggattacaggcacctgccaccacacccagataatttttgtattttttgtagagaaggggtttcatcacgttgcccaggctggtcttgaatgccatgaccgcccccagttgtgcttagaagataccgccaacaggccgggtgcggtggctcatgccttaatcccagtactttgggaggccgaggcagctggatcacgaggtcaggagttcgagcctggccaagatggtgaaaccccgtctctactaaaaataccaaaattggccaggcatggtagctcacgcctgtaatcccagcactttgggaggccaaggtgggtggatcatgaggtcaggagatcaagaccatcctagctaacacggtgaaaccccgtctcaaaaatacaaaaagttagccaagcgtggtggcacacacctgtagtcccagctactcagaaggctgaggcaggagaatcgcttgaacccaggaggtggaggttgcagtgagacaaggtcgtaccactgcactccagcctgggcggcagtgtgagactccatctcaaaataaataaataaataaataaaatattaaaacataaaaatacaaaaattagccaggcaaggtggcgagtacctgtaatcccagctactcaggaagctgaggcaggggaatcacttgaacctgggaggtggaggttgcagtgagccgagatcacgccactgcactctagcctgggtgacagagcaagactctgtctccaaaaaaaaaaaaaaaagaagacacctccagctgacagatcatgagccacatgtggcccaggcttgtcttgtttggcttttatagggagatagatttatatatatatacatatatatatatgttgttctgtagtgttgcgtcatgagatattgaaaaacacacataactttttttaaaatttgttctgggccaggcgtgtaatcccagtaatttgtgcagctgagatgggaggatcgcttgatctcaggagttcaagaccaacctgtgtgacacagtgagacactcatctctacaaaaaattaaaaattactggggcatggtttcgtgcacctgtggtcccagctgagatgggagaattgcttgagcacacgaggtcaaggctgcagtgagccaagatcgcaccgctgcactccagcctgggcgacagagcaagatcctgtctcaaaacaaacaaaaacaaaagtaaaactacaatgtgaatgcaagttttctcagaatatacatcctttaatattttgatctttgaattttcaatcactatctaccacagaatgttccctttccaaattacaactaatttataactcagtaaggaacactctgggacaagttcttttttttctttcttttttccaactctggatacagattggcagacagcagtcttgagagcttgttgggagggtctagcaggggagcacagctacttgtatgcccttgaccgaagactggtccttgtctatcggggatggttgtcctctttaacggagtgcacagcttcaggaggttgcacatggagtagtgagggaggaaggggacacccacctagccagccaggtcagctgaatcaaccctggcgatcagtggggtaacatgttgcagccagatcgccctcacatccaggcagcagtctttagtgaagtgctaacattgttcaacagagaaatccaatagctaggttggaggtgggcagagaaagggaagttataaaactcaccaggctgggcgcagtggctcatgcctgtaatcccagcactttgggaggccgaggcgggcagatcatgaggtcaggagatcgagaccatcctggctaacacggtgaaaccccatctctactaaaaatacaaaaaattagccaggcgtagtggccggcacctgtagtcccagctacttgggaggctgaggcaggagaatggcgtgaacccgggaggcagagcttgcagtgagctgagatcgcaccactgcactccagcctgggcgacagagcgagactccatctcaaaagaaaaaaaacaacaacaaaaaaactcaccaaagatttggctaacatcacatcaaaaggagtattctcattttacttaaaatgcccacatttgtgtttgttttgttttgttttgagacagagtttcactcttgttgcccaggctggagtacaatggtgcgatcttggttcactacaacctccgcctgcccggttgaagtgattctcctgcctcagcctgctgagtagctgggattacagatgtgccccaccatgcccggctaattttttgtgtttttagtagagatggggtttcaccatgttggccaggttggtcttgaactcctcacctcaggtgatctgcttgcctcagcctcccaaagtgctgggaatccaggcgtgagccaccacacccgaccccacatttgtttttatgatagaatgttttcataatttattatattactaagttgtgttttagatttttcagtttcaagtttggtttctaaaataaatgagtacaaaccacaagctcagtttctcctgaaactctcacagcctgcttctgacgtcagatgtgtgtgggttgcacactgcgttaatccattctcacactgctataaagaaatacctgagactgggtaatttataaagaaaagaggtttcattggctcacggttctgcaggttgtaaagaaagcatctgctcagcttccggggaggcctcaggaaacttacagttatgacagaaggtaaaggggaagcaggcacgtcttacgtggccagagcaggaacaagagagagagtgaaggggtaggtgtcacacacacattttttttttttttttgagatggaattttgctcttgtcacccaggctggtgtgcaatggcacaatctcggctcactgcaacctccgcctcccagattcaagcaattctcctatctcggcctcccaggtagctgggtttacaggcttgtgccaccatgcctggctaatttttttttttttttttagatggagtctcactccgtctcccaggctggagtacagtggctcgatctcggctcactgcaacctctgcctcccagattcaagtgattctcctgcctcagcctcctgagtagctgggtttacaggggcgcaccaccacacccggctaatttttttattttcagtagagacggggcttcaccatgttggtcaggctggtcttgaattcctgacctcgtgatccacccgcctcggcctcccaaagtactgggataacaggcgtgagccactgcgctcagccaattttttgtatttttagtagagctggggtttcaccatgttggtcagctggtctcaaactccagacctcaggtgattcacctgtctcggcctcccaaagtgctgggattacaggcatgagccaccgcacccggccagtttcacacacttttaaaccaccagatctcacaagaactccctctcacgacgacagaaccaagggggatggtgttaaaccatgttaaatcatgagaaaccaccctgacaatttaatcaccccccaccaggcatcagctccaacactagggtttacaatttgacatgagatttgggcagggacacagatccaaaccatatcacacaccaaacaagcaatcagttctactgcagacaccagctgggtgtcctctgatttttttttttttttttgagacggagtctcactgtcgtccagtgagattgcagtggtgcaatcttggctcactgcaacccctgcctcccgggttcaagtgattcctctgcctcagcctccggagtacctggggttacaggtgcctgccaccacgcccagctaattttttgtgtttttggtacagacggagtttcaccgtattagccaggatggtctcgatctcctgaccttgtgatctgccctcctcggccacccaaagtgctgggattacagtcttgagccaccgcgcccggccatgtccactgatttaatccaattataacatcatctacctggagatagcgtcacatctcacggggtgagggctgcatcccacaagactgcccctgacttccgatgccaattgcaagccccaggtttttttacctgcacttctaaccaactggctaataaatcagggttctcccggccctgcccttgggtgacattaacttgctagagtggctcacagaactcagagaaacatgtttaccagtttggttattataaaggatatttcaaaggccaggcacggtggcttatgcctgtaaacccagcactttgggaggtcgagacgggcagatcacttgaggtcaggagtttgagaccagcctgggcaacatggtaaaacccccatctctacaaaaaatacaaaaattagccaggcatggtggcatgcactgtaattccagctactcgggaggctcaggagtttgagaccagcctgactaacatggtgaaaccccgtccctactaaaaaatacagaaattagccgggcgtggtggcatgcgcctgtaatcccagatacttgggaggccaaggcatgagaatcgcttgaacccaggaggcagagtttgcagtgagctaagatcacaccactgcactccagcctgggtgacagagcaagactctgtctcaaaacaacaacaacaaagaaaaccaaagtgatccacccaccttggactcccaaagtgctgggattatagacatgagccaccatgccctgcctttttttttttttttcagacaggatctctcgctctgttacccaggctgtagtgaaatagtgtgataatgtgatcacagcttcctgcatccttgaccgcccccagcctcaagtgttccttccacctcagcctcctgagtggctgggactacaggtgaccgccatcatgcctggctaatttttgttttttctttttttagagatggggttttgccatgttgtccaggttggtcttgaactcctgggctcaagtgatcctcctcccttggcctctcaaagtgctgagattacaggctatgagcctctgtgcctggcccctaaactttttccaacccaccattccaccatgctccgtgtatcagctctccatactttatgacttcattgctttagtcactgttctgctacttgcagcctagggcattcctaatgacacatggtccacattagactttacagatagcctcattttctactagttttgcctatgaggaagacagccctagaaagtgacagctagattgagacctaaagagtaagaattagccaagatgaagtagtgggagggaggaagatggatgttgcaaaaggaagggagtgtttgttgaaatgatcagaagttggaaaaatcttttaagcatttttcttttctttagagatgggttctctgtcacccacattggagtgtagtggtatggtcatagctcagtgtagccttgaactcctgacctcaagggatcctcctcttcagcctcctggaattacaggcatgagccatcatgcttggctaatttatttttaaattttttgtatagacctggccacgtgtgagggctcatacctgtaatcccagcattttgggaggcctaggtgggtggatcatctgaggtcaggagttggagaccagcctggccaacatggagaaaccctgtctgtactgaaaatacaaaaatttgctgggtgtgctggtgcacacctataattccagctatttgggaggctgaggcaggagaattgcttgaactcaggatgtggaggctgcagtgagccaagattgcaccactgcactccagcctgggtgacagaccaatactctgtctcaaaaaataaaaataaaaataaattaaataaataaaaataaattctttgtagagaccgggtcttgctacattgcctaggctggtctcgaactcccagtctcaagcaatcctctcacttcagcctcccaagtagctgggattacaggagtgagccaccacatccgacccttttaagcatttttttttttttttttttggcaggcttactccaggtgcaatgtggaaaatagagacaggggaacatttaagcgcagtttaggagcaatgagtggagcagaaccaggatggaagaagtaagcatgaggagaagcaggcagaagtcaggggtgtttggaggtgctgatggggggcagaaaggagcctaggagaaagaagagtattaggcttggtgggggtggtcatgcatcctaaaataattttgaggtcttcacagggggatattgaagtggctgttagagagatagggtttgaagtcaggagagagacataggttaagacataggtttgggttcatgttacagagacccaggacgacagtgatttatacaaaagaaagtgttagttctctgtcgtgtaattacactgaggcaggcagttcaggtgtcctgtgctggctgcagggattcaagctccttccatctcctggctcagccaaccctggcatgctgccgttgtccatgatatctcaccatcatgtctggattctaaatagcaggagagagaaagaggagtggggaagaggagccagaaccagttgcatggatgcccttagccacaagggggtctgggaaatgcagcttttcctctgggtggccacaagcccagttaaaaataatggtgctggcaacgtgcatggcacacggctggaatcccagcactttgggaggctgaggcaggtggatcacttgagcccaggagctcaacaccagcctggccaacatagtgggaccccatctctacaagaaatacaaaaaatagccaggtgtcatggcacatgtctgtagtcccagctacttggaaggctgacacaggaggattacctgaaagtgaggaggtcaaggctgcagtgagctgtgattgcaccactgcactcgtcttggcaacagagcaagactctgtttcaaaaaagaaagaaaaaaagaagaggttgtattagtccattctcatgctattaataaagacatacccgagactgggtaatttataaaggaaagaggtttaattgactcacaattaagtatggctggggaggcatcaggaaacttatacagtcatggcagaaggggaagcaaaaacatccttcttcatgtggcggcagcaaggaaaagtgctgagccaaaggagcaaaagtcccttataaagccatcagatcttgtgacaactttatcaccagaacagcatggaggtaaccaccctcatgattcaattgcctcctacgacacgtggggatacagccaaaccatatcagaggtagtgctattcctttaaaataatgcgagaatagatctaggaggaccacatctgccaccgctggagatggagacatggggaacatcagggtatgagatagtaattggggccaggcgcagttggctcacgcctgtatcccagcactttgggaggctgaggcgggtggatcacttgaactcaggagttcaagaccagcctgaccaacatggtgcaaccccatctctagtaaaaaaaaatacaaaattaggctgggcgcggtggctcatgcctggaatcccagcacttagggaggatgaggtggacggatcacctgaggtccggagttgaagaccagtctggccaacatggtgaaaccccgtctgtactaaaaatataaaaattagccgggcatggtggtggatgcctgtaatctcagctacttgggaggcagaggcaggagaatcgctcaaacctgggaggcggagattgcagtgagctgagatcatgccattgcactccagcttgggcgacaaaagcgagactccgtctcaaaaaaaaaaaataaaatagctggacatggtagtgtgcgcttgtaatcccagagacttgggaggctgaggcaggagaattgcttgagcccaggaggcggaggttgcagtgaactgagatcatgccattgtactccagcttgggcaacaagagtgaaactccgtctcaaaaaaaaagagatagcaattggagccttgggcctaggtgaaatttcccagaaggagtgcagagggaggggaaaagcagcccaggactgacctttgagaaggcatgccgccagcaaagagagtcagagagcacggctgggtagcggggagggaaagcaggtgtgtgtaaagccacagagccatggggagagaacatttccagaagtgtccagtgctgtctgcaggaggcttgaaagtgtcctttgattaaaacagcaggtcatgattttgatggcagtcgtttctgtagagtgctggaagcccatggaagcctgcaaccagttgcagagggaggggaagatgagaaagtgtagactgctaggacagacggctcttcccagacgtttggctgtgaaggaggtgagaagtcgtgctgtgtgtgaggggtagagaatgagttgttggagctggacatgactcacccctgtaatccctgcactttgggaggctgaggagggaggatcacttaaggctaggagtttgagaccagcctgggcaacatggtgagaccctatgcctacaaaagtcaaaatactagttagatctggtggcatgtgcctgtaaccccaggtacttgggaggccaaggcagaaagatggcttgagcccaggagattgaggctgcagtgagccgtgactgcaccactgcactccagcctgggtgacagagtgagaccctatctcagaaaaaagaaaaaaaaaaaaaaagagttgttggttggctggttgttttaaggtgggagagatgtcaacttatttatatggggaaatagccttttgggtgatagtgtgaatggaataacctgacaagcatgtcctcaccactatgcatctagaagcgctgcataaaaccaaacaaacatcctttaaaacatgcagcttagttgcaaaaaagaaagggaaatccccaggaggcacgaagaggaaactgaacactagagctgtgcaacttgctgggtggctgtgatcttggcattgaagggcctagggctttacacctacctagagattggagataaggccttgtctggggaactgaaaacataaacactaatagaaagcttgtacccttaaggggtgacatccttggtgaaagagtaaactaggaaaaaaatctgcctccagttcagggagcataaaaggaccttgtctgtttcactctgagatttggtgacaataaatggtctcttttgagaattcataaccaaaggcttggcctcacttggacttggggttcaagtttacatcatctgcatggtctgggaagcccaaatgtcaacaaataatatagtccaggccaggtgtggtagctcgtgcctataatcccagcactttgggaggctgaggtgggaggatcacctgaggttaggatttcaagaccagcctggccaacatggtgaaactacgtatctactaaaaatacaaaaattagccgggcatgttggcaggagcctgtaatcctagatactcgggaggctgaggcaggagacctcgggaggtggaggttgcttgaccctgggaggtggaggttgcagtgagctgagatcgcaccactgcactccagcctgtgcaacagagcaagactctgtctcaaaataataataataataaataataataataataataataacaatgtagtccagggttggtaacacccatgaagagctcttggcagaagcagatgtgaaacctctttgaaccttggtgggcatgtgcattcccactgataacaccctgctgaagctgaattcacagctcaaaattacaaaacataagaggaaacaatcttcatgaatgacagtaagcagacacagcatatagcaggattagctccaactccagaactccagagaatagcattatttggcaaagaaccatacagcaagtgtggtttaaatttctaaagatataaaagaagacatcaatatgagaaagaaataagatggtgttaaaaatgagtgggattccggtcaatgaatgcgtctaaaaaaaaaagtgagcaggagaggtttaaagtaaaaagaagaaacagtaaaatgaatgtgtctgttaatctatgaacttattcattccccattcattaggctcctatagtgttttagaccatgttctgggtctggaaatataaagatgactctgcagatagcaagttagactctgcctcaggaagatcgcatgcagaaatccatgtatcaatgcatccatttatctatacatccactcatccacacatccattctcttcacctatccattctcccatccatccatccatccatccatctattcatccatccatctgtccgtctgtccatctatccatccatccatttattcatccatccatccatccattcatccatccatctagtcttccatccattcatttatttatccatccatccatccatccatccatccaaccgtctttcattttactcactgtgggggaaagaaagagagatctgactgttactgtgtctctgtagaaagaagaagacataagaaactccattttgttctgtactaagaaaaattctgccttgagatgctgttaatctgtaaccctagtcccaaccctgtgctcgcagaaacatgtgctgtgttgactcaaggtttaatggatttagggctgtgcaggatgcaccttgttaaaaatgtgtttgcaggcaatatgcctggtaaaagtcattgccattctccattatcgagtatctagggacagaatgcactgcggaaggctgcagggacctctgcccaagaaagcctgggtattgtccaaggtttctccccactgagacagcctgagatatggccttgtgggaaggggaagacctgactgtcccccagcccaacaccgtaaagggtctgtgctgaggaggattagtgaaagaggaaggcctctttgccgttgagataagaggaaggcatctgtgtcctgctcgtccctgggaacggaatgtctcggtgtaaggcccgatcatacattctatttactgagataggagaaaactaccttatggctggaggtgagacatgctggcggcaatactgctctttactgctctgagatgtttgtgtaaagtcaaacataaatctgacctacgtgcacatcgaggcacagcacgtttccttaaacttatttatgacacagagacctttgctcacgttttcctgctgaccctctccctaccattaccctatagtcctgccatatccgcctcactgagatagtagagatagtgatcaataaatactaagggaactcagagaccagtgcccgcacaggtcctccgtatgctgagcgctggtcccctaggcccactgttctctctctatactttgtctctgcatcttatttcttttctcagtctcttgccccacctgacaagaaatacccacaggtgtggaggggctggcccccttcactcattctcaaatgtcacagctagaaaagtcccaatagaacatcttgttcaactttcagctgtctttttgtacatgaaaaaagcacatgaggccccataatacaaaactctgttttctgaagtctctaagtgaataaggtgatggaggcagatcatgaactggggccttgtccctgcatttcttccacactgcagtgcctttcctgaacccatggcatggaagcatctgacctctgaacacctgcctgtatcttctgtttctctcaggtctgttcactcctcgtgggcagagtccccacaacccagtgctgtcaactgatggtgatgataaggaatgtcattacccagctcatgagtgatagagatgggacagggccctggtctctccctggtgtcagttttgtgtccatatcttagctcacccctacctttgttccctactctgccgctagagagactgtgagctccttgagggcagggcccaggtcttattcctcccctcccagtgcccagctcagaaacagtgcttaggatgctggccagtgactacacctgggagaagagactggactaggctctcggtccctctgcctggggtttctggctgctctgtcaacttccaacatcccaaaaatcagaggggaggtcaagggattggatgagaggctccaagtgctccttagcccactgtgcagggagaagtgagtgtttcctggctgtgggtgaacttcgtggacagcattaaacaacacagcatcccgccccctgtgcggggctgtctgtctgccttggcacttccagaaggtctcattgtggtgctagagtatctaacactttctgacttgcagatcaacattcccttttcttgttaacaaagagcagtgccgggcgcggtggctcacacctgtaatcccagcactttgggaggctgaagcgggcagatcatgaggtcaggagttcgagaccagcctggccagcatggtaaaaccctgtctctactaaaaatacaaaaattagccaggcatggtggcaggcgcctgtaatcccagctacttgggaagctgaggcaggagaatcgcttaaacccagaggcggaggttgcagtgagcggagatcgcgccatcacactgcagcctgggcaacagagcgagactccgtctcaaaaacaacaacaaaaacaaagagcagagttttaggtcaatgcttccagcagggaacagaatttagatcttaacaattttgtttacattgtatttattttcatgttttaccttctattgatggcaaatgagactggttttccatttacagaagtgatacaaaagattcctgttgcaataatttcattaagtgaataatgagccaatttaaagaaaaatataaagcaaataattgtacagatggtaaactaatatggcaaaatcactaatattcaaggctgaagtttggccgggcatggtggctcatggctgtaatcccaacactctgagagatggggatgagtggctctctcgagcccaggaattaaagaccagcctgggcaacatagcaagaccctgtctctaaaaaaaaaaaatagccaggtgtggtggtacatgcctgtagttccacctactagggagactgaggtgggaggatcacttaagcccaggagttcaaggccgcagtgagctgagattgtgccactgtagtccagcctgggcaacagagtgagaccctgtttcaaaaacaaaaaaaagtggccgggtgcagtgctcatacctgtaatcccagcattttgggaggctaaggctgctggatcacttgagcccaggagttggaaacctgcccaggcagtatggtgagaccgtgtctctacaaaaaaaatacaaaaattagctgggcgtggtggtatgcacctgcagtcccagctattctagaggttgaggtgggaggatcgcttgagcctaggagttcgaggctgtagtgagttgagattgtgccactgcactccagtctgggtgacagagttgagattctgtctcaaaaaaaaaaaaaaaaaaaaaaaaaagacaaagtttggaaaattaaacccccagggaaatggaaactacatctgctgctcacccacctgcctgcctctcctaaagggaagattgggtacttggggtcccatttctgtagggtggagcattataagtaagcctagcttgtggcaaatctgtctctctggacactccagcaagctggaagggacgatgatcagaggtcacagtttgggagttgccctgctctaggacaacgctcctctccacattggatgaaactcagtttcccctggccatggccttcctcaccatggagtggtgagggtccgaggctgagacgtgtgcagatggaggagaatgggcagaggagcctgtgggttttctctgactctaggtccccactccagcaagacagcgccgctgcagcttggcccagcaagttcctccttgcagtttgggggtcaaagccacagttcatatgaaacaaaatgttcctctgcctggtctggtcctctctttgtgtattttcctagaggacctcacagtgggtgagtggccaaggagaacaggatttgtggctctgggaaactggattcctgtcatctcctgccagctgtcatcgccacaccgaggctgttcagcaccgcaggacccgttctctttggtattggtggcttcggtaaacactgaaagaaggtggaggtggctggtcgatgccatttcctgactatctagtaccttgggttcttcatctggatgcgatcttgaaggcttctggcctggcattggctccacccccaggtctctgagccacagcccaggtagctgagcagaggcactgctgggcttcccctagtccacatagcctggccaccacccagacccggggagggggactccaggtggaaggagcctgggaagggcatcttcgctggggcagtctcaatcctaatgctggatcctggggtccccggtcccactgaggcaaggcctgcctcggggatctctggggaaccctggggattcagaaccccacactggtccggccttcacgcttccagaaagctgagatctgctccaaggtgacccgtggctggaggccccactcaggatccgggctccctggccgctgcctcctggcctgggggctcccaaactggacgctggcctctggcctctgctcgggttcagcccagctcaccaggcctgtggcggggggcctcccctcccagggctggggcccccagaaggtgctccgggctgggacctccagtacggtctgggggcccaagttgctgggagcagaatttggggctgagggggcaggtggggctgttgctcgggcctccaaagtgcccacctgggtgggaggctcaggggcccgatctgtcagcagggggaccgcagagccataccagtcctcagagcgctctcgggcggtgcccatgggctcaatccacagctctcctcctgggcgccacaccagggtgggtgcacggtggctggggtctgggcggagagcacggcggaacaggcgttcagccaacacagcggtggtgaggatgaagagcgcagccagggtggccaggaccagcatgatggggatgcagggcccacagggcagtgagggccatggggctgcttcccatgcggggggcccctccacgcgcccagagggcggctctggagtcaacggcatctgagagacacaggggtgagaagaggaagtaaatgaggcagagggggcacaaccaagatgagagagaggcagcaggtgtccaggaaagcctgggagaagggctgggcatgggggctcatgcctggaatcccagcactttgagaggtcgaggcgggaggatcacttgagcccaggagttcaagaccagcctggacacacagtgaaacctcatctctaaaaataatttaaaaactagctgggtgtggtggctcacacctgtagtcccagctacacaggaagctgaggtgggaggattacttgagcccaggagtttgaagctgcagtgaccccagattgcaccactgtcctccagcctgggcaatagagcaagaccctttctcaaaaatgaaaaagaacattctggagagacagagaagcaagagggaccagaaagggtaagcgtgagccaggtggggtgggaggacaggcagcctacctcggggcacagccaggccctcctgcctggctctccaggcctttccagaatccccatttccctcccagaccccagggtgcctcagacaagaaaggtctcaagggcttctttcctccccactcggccccctcaagtcttgctcagacctagagaggaagtggtgggtgaagaaatgagaacctcccctcccactggctcccctgcgtgtgtctcccccaccgcctgccgccagcacctccgctggccccttgaggctccttcgcccctcaccattctcctcggacttgatcttgctctcataggctccacggaatctgctgccgggccgggccgggccaggcctccggaggcgcctctgcacccctcctgggctccccagctttgcccaggctctggcctgtctctatctctcgtttgtctctgcacacctctctgtcccccacatcctccatctgcagggggcctcctgcacccctcaactcaccttgggtcagtccctgggctcctctccctcctagagccactcttcctggtgctggactaagaggtgcaggcttggagggtgcagggcggtccgcctctcagacgtagaggcccggcctcggatgaaggcggaagggagggcaccgcctgttgctgggcaactgtgccccaactcgtctgcccctggggagtgtttgtttccaaagcaacccaaggggatgtggtcactgcggtgaggaggcttttcctggggtaaggtggggctggaatgggcaatggttctgttgaacttagtgtcaccccatagccaggccctgagccccagaacattcaccgaaaagctgagaaagaggacgccggggccaggcacagtggctcacccctgtaatcccagcattttgggaggtcaaggtgggcaagtcacctgaggtcaggagttcgagaccagcctgccaacatggcgaaaccccatctctactgaaaaatacaaaaattagctgggcatggtgacgggcacttgtaatctcagctgctcaggcggctgaggcagggagaatcgcttgaacccgggactcggaggttgcagtgagctgagatcgtgccaccacactccagcctgggcaacagagtgagactccgtcttaaaaaaaaagaaaagaaaagaaaagaaaaagaaataggacactgggactttagcccgtacattcccagagaaccatggtgcctcccccgttcctcctgggaggatgccccaccccatcctgccttgtcttatccacggtgcctccccagatctgctcctgccatgcagcccccacaggcaccccctgcttggccagcttgcttcacaccttttttttttttttctggtagagatgggctcttgctatgttgcccaggctggtctcaagctcctggcctcaagagatcctcctgcctcagcctcccaaagtgctgggattacaggtgtgagctaccacactggcccctgcctcatacttttaattaacataagtctctctctcttcagaccatttagcccccattttggttggaaaatatcagtgaggtgaggcttgggtaacaaaaatgtcaagcctctgagaggagtccagggtataaaaacaggcgtgggcctgtttccaaaaccctgaccatcctcatgtctgtccctctttcctgctgctgagggtgggaggagcctggagcagagtgtgacaagatgtcatcaggctctggagtccaggtgactttctgagattctctagtttgactcatccacagatgacaaaagtaaggcttaaagaaaagagatttcatgaccaaagtcgcatgaccaatgtatgtgtgggtgagcatgtagtggccagggtggtggaagaatagatagaaatccctgggctgggcgaggtggctcatgcctgtaatcccagcactttgggagaccgaggcgggtggatcacctgaggtcaggagtttgggagcagcctggccaacatggcaaaaccccgtctctactaaaaatacaaaaattagccgggcgtggtgccgcacgcctatgaccccaactactcaggaggctgaggcaggagaatcgcttgaacccggtgcagtgagccgagatcgtgccattccactccagcctgggcaacagagcgagactctgtctcaaaataaataaattaaataaataaatgaatgaaaagacagtctccgtcagactgccccatcctggtggttttgagccctgctgggaggagctggagatggagagtccgggggaaaccgcctttgcaaagaaagagatctaacttaactgactccaccttgcttctaacctccaagctgtctttgtttattcctgggcgtaggctgaactaactttgggagaaacttagtttgtagtttatagtttaaacaaagacagtaacagccctttcccaaagcagaccttcttgcctggggactagactaacactagccataggattagaaattatggtttaggagtcatgcagctggaggctacaagattctgaccctccctaaactgctcctaacatcagtgcttgagatattttgcagaccctgcacttgatggatcagctggcaccacccagatcaataaactggctcatctgatcttgtggcccccacccagaactgactctgcaagaagacagctctgactcctgatgatttcatctctgaccaatctgcactcccagatcccagcactttgggaggaccagacaggcagatcacaaggtcaggatgagaggtgacagcgtgctggcagccctcactcactctgggcgcctcctcggcctccacgccaactctccctgcgcttgaggagcccttcagcccgccgctgcactgtgggagcccctctctgggctggccgaggcgggagcccgctccctctgcttgccagaggtgtggagggagaggcgcggacgggaactggggctgcgggccacgctcgagggccagcatgagttccgggtgggcgtgggctcggtgggccccgcactcagagaggccggctggcgccattggccccaggcagtgaggggcttagcacccagaccagcagctgcagagggtgcgccaggtcccccagcagtgccagcccacaggtgcacttgaattctcgcaggcctcagctgcctccccacggggcagggcttgggacctgcagcccgccatgcccaagcgtccccctgcctgggctcctgcaccgccccctgctctgcggggcctggtcccatcaaccgcccaagggctgaggagtgcaggcacaggattggtgggcagctccacctgcagcccaggtgctaggtccactaggtgaagccagctgggctcttgagtctagtgggcacttggagaacctttatgtctagctaagggattgtaaatacaccaatcagcactctgtgtctagctcaaggtttgtaaacacaccaatcagcaccctgtcaaaatggaccaatcagctctctataaaacagaccagttggctctctgtaaaatgggccaatcagcaggatgtgggtggggccagataaggcaataaaagcaggctgccagagccagcagtggcaactcggcgtacccttccacataggaagctttgttcttttgatctttccaataaatcttgctgctgcttatcctgggtctgcactgcctttatgagctgtaacatcgtgaaggtctgcagcttcacgccagaggccagcgagaccacgaacccaccagaaggaagaaactcggaacacgtccgaacatcagaaggaacaaactccggacatgccgcctttaagaactgaaacactcaccgtgagggtccgcagcttcattcttgaagtcagtgagaccaagaacccgccaattctggacacaaggagatcgagaccatcctggctaacacggtgaaaccccatctctactaaaaatacaaaaaatttattaggcgtgttggcggatgcctgtagtcccagctagtcccagctactcccagctacttgggaggctgaggcgggagaatggcatgaacctgggaggcggagcttgcagtgagccgagattgcgccactgccctcaagcctgggcgacagagcaagactccatctcaaaaaaacaaaacaaaaacaaacaaaaaaaccctctgtttcccgaatgctcagggagactgatttgagtaataataaaactcctggctggacacagtggctcacgcctgtaatttcagcaatttgggaggccaaggccggtggatcaccttaggttgggagtttgagaccagcgtgaccaacatggagaaaacactgtctctactaaaaatacaaaattagccaggtgtggtggcaagtgcctgtaatcccagctactcaggaggctgaggcaggagaatcacttaaaccctggaggcggaggttgcagtgagccgaggtggcaccattgtactccagcctgggcaaaaagagcaaaaccgtcaaaaaaaaaaaaaaaaaaaaaaaaaaaactccggtctcctgcacagctggctctgtgtgaattactctttattgcaattttgctgtcttgatgaatcggctatgtgtaggcagcgggcaaggtgaacccctttggcagttacagggggaagctaaggctcaggacactcgcagaaacctgaggaggctagaattttaccagattacaagccttaaaatcaaacctgaagttagtgccagcgaacaacacgcttaaaaataactaagatgttctttctggctgttctagaggtcaatatagaaaaatgatagtaactttgatgttattttatgttatgtatttctttttttcttttgagacggagtctgtctctgttgcccaggctggagtgcggtgacgcaatcttggctcactgcaacctccgcctcccgggttcaagatattcttctgcttcagccatccaagtagctgggattacaggtgtgtaccaccgtgcctggcagttatgtgtgtttccctacaatcaaacaatgatttattgtaaaaaaaaaaaaaatcaaaataaacaaaacctgaaaacttgtatgtgctcttttaatcaatctttttaaacaaacttttagaagagttaacattattaaaaactggaaagatcagacatggttttttcttactaagatatcactggctgttttgattctttcatcacgtacaagtttaggccctacacaatggttcatgcctgtaatcccagcactttgggaggccaagacaggtggatcacctaaggtcgggagtttgaggccagcctgaccaacatggcgaaaccccgtctctactaaacataccaaaaaaggccgggtgaggtgactcacacctgtaattccagcactttgggaggccaaagcaggcggatcatgaggtcaggagttcgacaccaacttggccaacatggtgaaaccctgtctctactagaaatacaaaaattagccgggtttggtggcaggtgcctgtagtcccagctacttgagaggctgaggcaggagaatcgcttgaacccaggaggtggaggttgtagtgggccgggatcatgccactgcactccagcctgggtgacagggcaagactctgtctggggaaaaaaaaaaaaattagctgggcgtggtgacacatgcctgtaatcccagctactcaggaggctgaggcaggagaattgcttgaacccaggaggaagaggttgcagtaagctgtgatcatgccactgcactccaccctggacaacagagcgagactctgtctcaaaaaaaaaaaaaaaaagtttaaggccaggcaaggtggctcatgtttgtaatcccacaattttgggagactgaagcaggaggattgcttgagggcaagagtttgagaccagcctgggtaacatagcaagactcccatttctacaaaaaatcaaaaaattagccaggcatgatggcatgtgcttgtagtcttagttacttgggaggctgagaggggaggatcacttgagctcaggagttcaaggctgcagtgagctatgggtgtaccactacactccagcctgggaaacaaagcaagacactgtctcaacaacaaaaaaagaccaagtatatttagtcattctataaaatttaagaagccagccaaaaacatttatgttcagcaatttgtttcagttatttcttcttacttggaaataatacacacatctaatgaataatagttaatttaatagaacataatagaagatttaaaattacatgaaaaatttatttataataaattatccattacatactttatttttaacagtttccctagattatttatgaaaactgagatattaggcaaggatagtcattatttcaagttacttccctgttaatcatttttatagcctgtgacaatcaggtattcacctaagtaagaagcttaaacatatgagtaatttcttgataactcaggagatacagttttttttttttttttttttgaggtggaatctcgctctgtctcctaggctggagtgcagtagtgtagtctcggctcactgcaacctctgcctccaggttcaagcgattctcctgcctcagccccccgagtagctgggactacaggctcctgccaccacacctggctaatttttgtatttttagtagagacggggtttcactatgttgtccaggctagtcttgaactcctgacctcaggtgatccacccacgtcggcctcccaaagtgctgcgattactaaaccaccatgcccggccgatatagatgtttttactaaatgaaaaatattaaattagtattacttatcaaaaattacacaggctgggcgtggtggctcagatctgtaatcgcaataatcacactttttctttttcttttttcttttttttttgagacggagtcttgccctgttgcccaggctggagggcaatggcacaatctcggctcactgcaacctccgcctcccaggttcaagtaattctcctgcatcagcctcccgagtggctgggattacaggcatgcaccaccacgcccggctattttttttttttttttttttatctttagacagagtttcaccatgttggctgggctggtctcaaactcctgacctcatgatccatccgcctcagcctctcaaagtgctgatattacaggcgtgagctactgtgcctagcaacactttttctttttctttttttttttttttttttttttttgagacggagtctcactctgtcacccaggctggagtgcagtggcatgatctcagctcactgcaacctccgcctcccaggttcaagcaattctcctgcctcagcctcccgagtagctaggattacaggtgtgtgccaccatgcctggctaatttttgtatttttagtagagatggggtttcactatgttggtctcaaactcctgacctggtgatccacccccttcagcctcccaaagtgctgggattacaggcatgagccaccatgccctgcgtcactttttcttttaattaatttaaaaaaatttgtttttagacagagtctcactctgttgcccaggctggagggcagtggcttgatctcagctcactgcaacctccacctcctgggttcaaatgattctcctgcctcagcctcctgagtagctgggattacaggtgcgcaccaccatgcctggctatttttttttttttttgagacggagtcttgctctgttgcccaggctggagtgcaatggcatgatctcggttcactacaacctctgccttccaggttcaggcgattctcctgcttcagcctcccaagtagctgggattacaggtgcccgtcaccatgcccagctaatttttgtatttttggtagagatggggttttgccatgttggtcaggctgctctccaactcctgacctcaggtgatctgcccgcctcggcctcccaaagtgctgggattacaggtgtgagccactgcgcccggccattttaatttaaatagagatggggtcttgctgtgttccccaggctggtctcaaactcctggcctggagcagacctcccacctcggtgtcctgaagttctgggattataggcataagccaccatacctagcctaatctaaacactttgggaggcaggaggattgcttgaagatagtagttcaagaccagcctgggcaacacagtgagactccatctctaccaaaaaaaaaaaaaaattagctgggcatggttccatgtgcctgtagtcctagctactcaagaggctgaggcagaggatcacttgagcccaggagttcgaggttacagtgagttatatcatgctacctggacagcagagcaagaccctgtctctaacaacaacaaaaaattatacaaacacagatcattttgtttaaaactggatttgtagtcttataacccttgtgtcagaccctgacaccttaaaacatctagtagagataaatataaaactgtctggccagtaaacccaagcaaaaatgtatgctgataattctgaagacatttctatttttattttaccaatactttttttctttgtcttttttttttttttttttttttttttaaagagagttttccttggtcacgccagctggagtgcagtggcatgatctcagctcactgcaacctctgcgtcctgggttcaaacaattctcctgcctcagcctcccaagtagctgggattacaggcacttgcctccacacccagctaccttttttgtatttttagtagagacaaggtttcctcatgttggccaggctgatctcaaactcctgacctcaggtgatccacccacctcacccttccaaagtgctgggattacaggtgtgagccaccaagcctagcctattttaccaatagttttaaaaccagcttatttattaaagattaaagatttacggcagggcacggtggctcatgcctgtaatcccagcactttgggaggccaaggtgggcggatcacgaggtcaggagatcgagatcatcctggctcatagtgaaactccatctctactaaaaaaaatacaaaaaagtagccaagtgtggtggcccacgtgtgcctgtaatcccagctactcgggaggctgaggcagaattgcttgagcctgggagacggaggttgctgtgagctgagatcatgccactgcacttcagcctggccgacagagcgagactctacctcaaaaaaaaaaaaaagaaagaaaaaaaatttttttttcagtttcggctgattgaggtggctggtgcctgtaaccccagcactttgggaggccggtgtgggaggattgcttaaacccatgagctcaagaccagactgggcaacaaagtgagacctcatctgtacaaaaaatgagaaaattacctgggcatagtggtgcatgcctgtagtcccagctcaggattcaactggggaggtcgaggcaggaaaactgcttgagctcaggaggttgagctgtgtttgtgccagtgcactccagcctgggcatgagagtgagactgtctcaaaaaactgttttttatcagtttcaaatgagtttagggttaaattttcaattgtttacattttagccaggattggctaaattgtataagaaatacaaaatatctaagtgccctggaactagtaacacgtctatgttttgtttgctgatctggtttgatttgcaaatgtgggcaggaaagaactttagcaggtgttttttttattttgtttttgtttttgccttttggcctctgtgtgacagaaaaagcaacatttttatgctggacagagataccttacattattgctctgagctcaaggtttcaacttctttgatctaagagagtctaacttttatagaccttttttttggtgttttattttattttattttatttgagacggagtcttgctctgttgcacagggtggagtgcagtggcgtgatcttggctcgctgcaagctccacttcccaggttcaagagattctcctgcttcagcctcctgagtaattgggacaacaggcacgtgccactgcgcctggctaattttttatatttttagtagagacggggtttcaccatattggccaggctggtctcgaactgtttttttttttttttttttttttttttttttttttttgagacggagtttcgctctgtcgcccaggctggagtgcagtggtgcgatctcgactcactgcaagctccgcctcccgggttcacgccattctcctgcctcagcctcccgcgtagctgggactacaggcgcgcaccaccatgcccggctaatttttgtatttttagtagagacggggtttcaccgtgttagccaggatggtctcgatctcctgacctcgtgatccacccatctcggcctcccaaagtgctgggattacaggtgtgagccaccgtgcccggccccggtctcgaactcttgacctcgtgatccgcccgcctcagcctcccaaagtgctgggattacaggcgtgaggcaccgcgcctggccttataaacatttgtctagttatttttctttcttcctttctcgctttctttcttcttttttttttttttttttttttttttttttttgagatggagtcttgctctgtcacccaggccagggtgcgttggcgtgatcttggctcactgcaacctccacctcctgggttcaagcaattctctcatctctgcctcctgagtagctgggactatagacatgcaccaccacacctggctaatttttgtatttttagtagtgacggggtttcgccatgttgggcaggctggtctccaactcctgacctcaagtgatccgcctgccttggcctcacaaagtgctggcattacaggcgtgagccaccacacctagcctttttctttagattattactttttcaattaagtgtttcatcactctaagcaattgttaggcaaacctaattttatgtttttaaaacatggctagctgtcacgcccgtaatcccagcactttgggaggtcaaggtgggcagatcatgaggtcaggagatcgagaccatcctggccaacatggtgaaaccccatctctactaaaactacaaaaattatctgggtgtggtggcaggtgcctgtaatcccagctactcgagaagctgagatatgagaatcgcttgaaccagggaggcggaggttgcagtgagccgagatcacaccactgcactacagcctggtggcagagcgagactctctttcaaaaaaaaaaaaaaaaagaaaaaaaaaagaaaaggactaactggtctgaatattgtgcacctgttagtactagctactccagagtctgaggcagcaggattgctgtagcccaggagtttgaggtcacagtgagctacaatcatgccactgtactccagcctgtgcaacatagcaagatactgtctttaaaaaaaaagttgtctaggttgttggttaccatggagttgtaatttgaaagccctttaagacttttgtttaatcttgacttgaatgccataagcagtaagtgttatctcaacaccaggggaaaagttagcagattcaaagcaggcagaaaaaaaaaaaggagagaaagagaacttagaagtctctccatgctaactctatagttgtaggttttatgaataatgaccatttgagctctgaattttccttgatgtaattttgctcatcagttttaaaatgtgcacaagaatgagccataatatgtagctggtggagtcctagaaatccttgcattggccaggtgtggtggcttaagcctgtaatcccagcactttgggaatccgaggcgggtggatcacctgaggtcaggagttcgagagtagcctggacaacgtggcgaagccctgtctttactaaaaatacaaaattagccgggtgtggtggtgcatgcctgttatcccagctactctgaaggctgaggcaggagaatcacttgaacctgggaggcggaggttgcggtgagccaaggtggcactattacactccagcctgggcaacaagagtgaaactctgtctcaaaaaaaaaaccaaaacaacaacaacaacaacaaaaaccagaaatcctggtacgccttcatgtttgagaatcccattccatttctttatcttgttttttttttttgagacagtgtcttgctctgtcgcccaggctggagtgcagtggtgcgatctcggcccactgcaacctctgcctccaggattcaagtgattcttctacctcagcatcacgagtagttgggattacaggtgcctgccaccatgcccagctaaattattttttttgttttggtattttttagtagagatggggtttcaccatgttggccaggctggtctcgagctcctggcctcatatgatccacctgcctcggcctcccaaagggctgggatcacaagtgtgagccaccacaccatccccattccatttcttattcatcacttgagagcaaagaccaccctatacatgctgtaatttatgggatattaggagtttagtctggtgttttagacagcaggaaccaccctagtggcttatgttagccatcctccacccactggttggaatgtttatttttgctcttgggagatttttagaaataagcaagagaaaagagtcaaaccaaatccaaagaaaccaagataagagtgttcacaaaaattttaatccaaactggccatgcagaccaaaggttgcagtgagccgagattgcatcattgcactccagcctgggcaaaaacagtaaaactccgttaaaaaaaaaaaaaaagagggaggctcagcctgagagaagactcagcagggcagaacaggcctgttgtggaagcagagagctcacagccttcagtgagtgctgcatgccagttctaagaatcatcgattcttgggaggctgaggcaggcagatcacctgaggttaggagtttgagaccagcctggccaatgtggtgaaaccctgtctctactaaaaacgcaaaaattagctggacatggtggcgggcgcctgtaatgccagctactcaggaggctgaggtaggagaattgcttgatcctgggagacggaggtggcagagagctgagatcgtaccactgcactccagcctgggtgacagagcgagactccatctcaaaaaaaaaaaaaaaaatcatcaattccttctaatagtgattttttcaggtaccatttctatatatagatataccatgtatatctacctaataacagagggtctttaaaagaaaatgatgtttatttgggaatagtgcaatgggaatacatatgctatagcaaacaatgtgtgtattcagggaggtaaaggaacaaagatcaacaacaatgccaggcacagtggctcacgcctgtaatcccagcactttgggcggctgtggtgggaggatcacttgaggccaggagtttgagaccagcctgggcaacatagtgagaccccatctttaaaaaaaaaaattttttttttaaattacctgagtgtggtggtgtgcacctatggtcccagctactcaggaggctgaactaggaggatcccttcagcccaggagtttgaggctacagtgagctataatcatgccattgtactccagcctgggtgacaacatgagaccccaaaaggagaaagagagtgagagaggaaggaaggaaggaaggaaggaaggaaggaaggaaggaaggaaggaaggaaggaagaaaagaaagaaagaaagaaagaaagaaagaaagaaaggcagagaaagaatattagctgggcatggtggcatgtacctgtagtcccacctactcaggaggctgaaatgggaggattgcttgagcccaggagttgaagaccagcctggacaacatagcaagaccctatctctacaatatatacatatttttttttttcctgagatggagtcttgcttgcccaggctggagtgcagtggcatgatctcggctcactgcaacctctgcctcccgggtttaagcaattctcctgcctcagtctcctgagtagctgggattacaggtgtgagccaccacgcccagctaatttttgtatttttagtagagaccgggtttcaccatgttggccaggctggtctcgaactcctgacctcatgatccccctgccttggcctcccaaaatgctgggattacaggcgtgagccacctcacctggcctttttttttgagatggagtctccctctgtccccaggctggagtacagtggtgcgatctcagctcactgcaacctctgcctcctgggttcaagtgattctcctgcctcagcctcccaaatagctgggattataggcccccccacgacgcccagctaatttttgtatttttagtagagacggggtttcaccatgttgtccaggatggtcctgatgtcttgacctcatgatccacctgccttggcctcccaaagtgtgagattacaagagtgagccactgcgcccagccaaaatattgttttaaattagccagatgtggtggcacacacctatattcccagctactttggaggctgaggtgggaggatcacttgagcctaggagtttgaggctgcagggagctatgatcgcaccagcgtactccagcctgggcaacagagaaagaccctgtctcaaaaaaaaaaccaaaatagttatgctccttggagttgtgtccttggcactcttggttcctgagtctatatggcgggtttttgtttgtttgtttgtttttgagatggagtctcactctgttgctgaggctggagtgcagtggctccgtgtcggctcactgaaacctccgtctcccgggttcaagcaattctcctgcctcagcctcccgagtagctgggattacaggcgcctaccaccacacccgattagtttttatatttttagtagagatggggtttcaccatgttagccaggctggtcttgaactcctgacctcaggtgatccacccaactcagccccccaaagtgctgggattacaggcgtgagccaccgcgcctggcctacgtggtggttttaaaacatgtttgcaaaatttttaacattcctcctattgaaaatagtaagtctaattcccctcctcttgaatattggctggccttagtgactgaatcctcacaagtagaatgcatcaggagtgtcacactatgacttccaaggctaggttgaaaatataaaaggggtaaagctctctttcctctgtcgctctatttctttctctttctctctatccccacccttttccctctcctccctctactcacctttggaacccagccgctatcgagcccaacacacacgcaggtgccctggttaaagtcctagctagggtcccaagtgacagccagcatcaactataacatgtaaaggagccagtcttcagatgattccagcctcagccttcaggccactcagctggtgccaaatagagtagggatgagctgtccccacagagacctgcccagtgcacattgtgagaaaggtaagtattgctctctgaggccattaagtttgggggtggtttatggcataaaaattggtaattggagcactcgacttcaagggttctcaccaggtgtgtgagggtgagggtggccctgcggagtgagtggcctgtgggggctggtcatatttcatccctaggctctcccgacctggctctgccagattcttacacggatgagggcctggactggggaggaggagggggagtgcagcagcagcaagggcatggaattggctgagaaattccacaggaggccaggtgcagtggcttacacctgtaattctagcactttgggaggccgaggcaggtggatctgaggtcaggagtttgagaccagcctggccaacatggccaaaccccgtttctactaaaaatacaaaaataattaggcatggtggtgggtgcctataatcccagctactcgggaggctgaggcaggagaactgcttgaacccggggggcggagattgcagtaaaccaagattgcaccactgaactccagcctgggtgaaagagaaactctgtctcataaaaaaaaaaaaaaaaaaagaggccgggcgtggtggctcatgtctgtaatcccagcactttgggaggccaagtcgggtagatcacttgaggtcaggagttcaagaccaggctggccaacatggtgaaacccccgtctctaataaaaatacaaaaattacccggatgtggtggtgctggcctgtaatcccagctgctctgtagactgaggcaggagaagcgcttgaacccgggaggcggaggttgcagtgagccgagatagcgccaccgcactccaggccagcggacagagccagactctgtctcaaaaattaaaaaaaaaaaaacaaaaagaaactaggaaactggcaggagctgtctccaggtcccaaaaggataaagtgaaaaacccggcaggccagcagatggccaaaaaagccatccctagctgccctcattgctcattagggtaagacactctcatcagcgccatgacagtttacaaatgccatggcaatgacccagagactattgccgtttccatacaatgacccagaaattaccacccctttcctagaaagttctgaataacttgcctcttgatttgcattaacccaccccttaatttgcatgtgattgagagtggatataaatacagttgccaccaacccacaagcctggttctggcaccctgcctatgagttagccttgctcagcaaggagcagctccagttcgataaaagattgctgaagattggccaggcgcagtgtctcacgcctgtaatcccagcactttgggaggccgaggcgggcgaatcacaaggtcaggggatcaagaccatcctggctaacatggtgaaactccatctctactaaaaatacaaaaaaaattagccaggcagggtggccggcgcctgtagtcccagctactcgggaggctgaggcaggagaatggcgtgaacccgggaggcagagcttgcagtgagccgagattgcaccactgcactccagcctgggtgacagagcgagactccatctcaaaaaaaaaaaaaaaaaaaacagattgctgaagatttcacccctgaattcttttctgggcaaagccaaggaccctcttgggctaagccccggttttagggcttgcttgcctgcccctgtatttattccagaaagttctgttggacattgttgatgggtaggaccttgggcactatccagagtgtggtcttagaatcagcatcatcaaggccaggcgcactggctcgcctgtaatcacaacactttgggaggccgggtggattacctgaggtcagaagttcgagaccagcctggccaatatgataaaaccccgtctttattaaaaatacaaaaaaattagccggacgtggtagcgggcacctgtaatcccagccatttgggaggctaaggcaggagaatcgcttgaacgtgggaaacagaggttgcagtgagctgagatggcaccattgcattctggcctgggcggcaagagcgaaactctgtgtcacacacacgtacacgaaaaaaggaatcagcagcatcaggatctcctaccccctgcccctggcaattacccatctgctttctgtccctgtggctgtatctattctagacgtttcacatgagtggaatcctgccctgtcatcctttgtgcctggctgggttccggtggcctgatgcttcatggttcacccatgcgactgcacggctccttgtccatggcatggatagactgcattttgtttattcattagttgatggatatgtgggttgtttccactttttcgctgttacaagtaatcctgctatgaaaattgatgtcccagtttttgtgtggacatatattttcagtttatcttgggtatatacccaggagtagaatgctgggtcatatggtaaatctatgtttaactttttgaggaactgtgggtggcccaatttacaactgctaagttcatccacttcttactttctccacggaactcacacttacagcagtgatagctttcacacctccctcgtccgcactgttaaacactaccacaaatcaggctactgggaaaagcctggaggccaccagcctcctgcaagaaaagcaccagcaggctgggcacagtggctcactcagtggctcatcccagcactttgggaggcggaggcacgcggatcacctgaggtcaggggtttgacatcagcctggccaacatggcaaaaccctgtctctactaaaaatacaaaaattagccgggcgggtggtgggcacctgtaatcccagctactcaggaggctgaggcaggagaatcgcttgaacctgggagatggaggttgcagtgagccaagatcacgtcactgcactccagcctgggtgacagagcaagactccctctctctaaaaaaaaaaggaaaaaggaaaagcaccaacacaggtgacgcaggtcctctaggagaccgtgtctggttctcttcctgccacacgcatgccactcatgccgctgaagccaaaacacctcctcctatgtgaccagaattctgggtcattttatgatttctttctttttttaaattaaaataaaaaaatttttttagacacacgatctccctatgttgcccaggctggtctcaaactcctgggctcaagcaatcatcctgcctcagcctcccaaagtgctgggattacaggcttaagccaccaaactagacctttttttgtttttattttttagggacaaggtcttgccctgctacccaaaccagagtgcagtggtacgatctcggctcactgcagccaaaacctcctaggcttaagtgatccttccacctcagcctcccaaagtgctgggattacaggcgtgagccaccacagtagacctcctttttgttttattttttagggacaaggtcttgctctgtcacccaggccagagtgcagtggcatgatctcaactcactgcagcctcaacctcctaggctcaagtgatcctcccacctcagcctcccaaagtgctgggattacagatgtgagccaccatgcttggccccatgagacatttaaatcttcaagaagagggtccagggcttcctgttgttcttcccatcaccctcgcccctctgcagggggtcctaacgcagctaacagttccagccttcttcaggggcttcttgctgtcagcacggaataaagtcagagctgagctcaggagagttccgtcactcgccaagactggccaggtctcttctgtccttggctgtcaagattccaaacttgagaagtgagaaaaacaatgggaatgagttagaaagttcccaagtgccacctttctgaaggaattccagggtggaacaagctgggttttgcagccagttagccctaagattaaatctgagcttctctgtttaatagctgtgagagtcttagcaactacttaatttgggtgggtctgaatttctatttttcactaattcccagcgtgaatggctgtcaggggggtaatagtttatttatttatttttatttaatttaattaattaatttatttttgagacagtctccctttgttgcccaggctggagtgcagtagtgcaatctcagctcactacaacctccgcctccttggttcaagcgattctcctacctcagcctcccaagtagctggaataacaggtgtgtgctaccacgcccggctaacttttgtatttttagtagagatggggtttcaccatgttggccaggctggtctcaaactcctgacctcaagtgatccgcctgccttggcctcctaaagtgctgggattacaggcgtgagtcattgcacccggcctggataatactagtttagataaaccacttcataaagtgggtatgcaatgctttgtttcctctcaccttgacccagcattgcttgtcatctctgaaagaccacaaagagacctgcccctccacttcagggacccacttgaaacctggtcaccatccaggcttgctctgccttggccatcaggttccctgggcaccaagcctctcttttctcccgctgcacctgccagcccgtctgacagcactggatcctgcaccctggagtccgtttggactcacctgccctgaccttacttggcttcctctgtgatgttgactttatcgaccgcttttgccagcctggtctgtcggccacaccctacccataaatcttctaccttggatctatacaactgcctcccttttgtcctgtccccagggtagtgagccctccagggcctgcagccccagctgtcctgatccttttctcctgaagcaaaggaagatgtgttcatagtgtacccactgctgatctttctcctctgtccaaacatctccagtcctgtgctactgccctggacataatcgtttattttgtttttttgttcttttttttttttttgacacagagtctcactcggtagctcaggctagagtgcagtggcatgatcttggctcactgcaacctccacttcccggattcatgtgattctcttgcctcagcctcccgagtagctggaattacaggcacgcaccacctcacctggctaatttttgtatttttagtacagacggagtttcaccatgttggccaggctggtctcaaactcctgacctttggtgatccacccaccttggcctcccaaagtgctgggattacaggcatgagccaccgtgcccggcctgccccggccatattagattctgagtcttctatgtccctgacaattggctaagcacattttaatatgtcttgtatttttttttttttttgagcagagtcttgctctattgtccaggctggagtgagtggtacagtagcggctcatagcaacctctgcctcccgggttcaagcgattctccctgcctcagcctcccgagtagctgggattacaggctcccgccaccatgcccgactaatttttgtatttttagtagatgcagggtttcactatgttggtcaggctagtcttgaactcctgacctcaggtgattcgcccgcctcggcctcccaaagtgctgggattacaagtgtgagccaccacgcctggccctaacctgatgtttttatcagcatctgtaagataagacttcaggaactggtagattctgcaggagtaacatggggtgcccatagagaaggggccctcttatgaccacagcatttaccataacctgtgtaatgggcatattcagtgggtgaatattcctgtcaccacaaacccagttgcacatgacttgtatacaaagcatatcagctgcttcaccaggggtgctccaattggcgtttataggggaagttgggcagttcccttctgagggtaaacatatgtttgttttttttgtttgtttttttttttttggagacagggtctcacattgtcacccaagctggagtacagtggtgcgatcacagctcactgcagcctcaacttcccaggctcaagcgatcttcccacctcagcctcctaagtagctgggactacaggggctcaccaccatgctcagctaatttttttatttcttgttgagatgggatttcatcatgttgcccaggctggtcttgaactcctaagctcaagtgatccacccacctcagcctcctaaaatgctaggattacaagcgtgagccactgtacctggccaacacacttagcagtggcttttatccactccaccaggctatgagcatgctggcccttcatgaatattcataggtcctcttataacctgttgaatacgtacaccttgtcaacccattcagcataaattcctgtctcatctttctctccctcaaaatgatctatgccagaggctacacttcccagcttgtcaagatggccaccctaccaccgcaacccctgataggaaataatgtctcctctccaaatttgtagatatctgtgtttgtttgtttgtttgtttttcctgagatggagtctcaactctgtcccccagactagagtgcagtggcaaaatcttggctcactgcaacctccgcctcccaggtgcaagccattctcctgcctcagcctcccgagtagctgggactacaggcatgcgccaccatgcgcagctaatttttgtatttttggtagagacagggtttcaccatgttggcaggctggtctcaaattcctgacctcaagtgatctgcctgccttggcctcctgaagtgctgggattacaggcatgagccaccatgcctggccagatctccagattttaagttgatgccttagaatatcacattgtcgtatgttctagacagtgatcactcttctgaggaggaaaactaataaagggaacaaagggcaaataaattaaacaaaggtcaaaaccaaagcattgcagttgcaaagcaattcagtaggagatgtggaaattgtgaagcagaaactccaaagttaaacaaagttaccatgtaaattacaccacaataaaaacaaacgaacaaacaaaaaacagaaagttaaaaccaggagcttcagttgtccaaatcaatggacataaaattcttcttccagtcttatgatgcatttgacaagatctccagtatctactcaagttaacccatgaaatatagctaatggtagatgagtaagataaaggctgtccagatctttatctgaaagaggccgaaaagaaagaccagagtatttcgtgaaaatctgaagggagaataaaaatttcacttactacctaccacgtgccaggcctgtaccagggggttgaaaaaaattggtgggtcttattatctccaatttacagatgaaaaaactgaagctccaggccgggcacagtggctcatgcccttaatcccagcactttgggaggccgaggcaggtggttcaccagattaggagttggagaccagcctggccaatatggtgaaacctcgtctctactaaaaatacaaaaattagccagatgtggtggcacttgcctgtagtcccagctactcgggaggctgaggcagaagaatagcttgaaccagggaggcgggggttgcagtaagccgagatcacgccactgccctccagcctgggcaacagagtgagactccatctcaaaaaaaaaacaaaaaacaaaaaaaaaactgaagctcagtgggttacatggtaggtaagggctggagccaggtgttaaacccatgtatctgttaaaattaaaacttaagacaaattaaatttaagagagtttaattgagcaaagaacaattcacaaatcaggcagctccctgaaccagcataggttcagagaaactctggggctgccatatggttggataataattatagacggaaaaaggaaagtgacatacagaaaatggagatgaggtacagaaatagccagattggttaaggtgtggcacttgccttatttgaacatggtttgaacagttggccacttgtgatgggccaaaactctgtggttggtataagagaaggttatagtctatttacatgtccagttaggccactaggtgaggagaaacctttaggcctaaattaaaatatgtaaggaggcagctttaggctaaacttaatttaacaattctcttggccatgcgcggtggctcatgcctgtaatctcagcactttggagggccaaggcaggcggatcacctgaggttaggagttcgagaccagcctggccaacatagtgaaaccccatctgtactaaaaatacaaaatttagctgggtattgtggcaggcgcctataatcccagctacttgggaggctgaggcacgagaatggattgaacccaggaggtggaggttgcagtgagccaagattgtgccgctgcactccatcctgggcgatagagctaagctcagtctcaaaaacacaaacgaaaacaaagaaaaccaattatctctttttggccaactttcaattttgagagattgataaaaagctttaggcattgatgtcactctgtcaccaccgtgaatggacttttttggtctaaaatcccactaggaaacatagcagtgggttttgtaaggtgggaataaggaaatagagcaataaggaaaaacctcgttattccaggttacttttttgggatgggttggagcagaggggagcttcttattatgctggaatttgttttcaggaggaaaaacctggtctgttttgggatctctctgctttctttgaagtttgagtttgattatgtagcatttagcatgggtgactccattttggtttggtcttttggggtctagttcaggagctcaggccagaaaaacagcctcccataactttacttaacatctctttataacattctgtccacaaatgcttggtacgtggctataggtttctggcttaaaaaatgattaacaatgtacccttacctaccctgaatctgagcccctgcagcctctctcatactactgtggccacccaagctgccctgaggtttcccaaccaaggtggctcacatccgtattcccagcacttgggaggctgacgtgggaggatcacttgagcccaggagttcaagaccagcctgagcaacacagtgagacttcatctctacaaaaagtaaaaatgcaaaaatttgctggggggtggtcccagattcttgggaggctgaggtggaaggatcaatagagcccaggaggttgaggctacagtgagctgtaatagtggcactgcactccagcctgaggtacagagtgagaccctgtctcaaaaaagaaaaaaataaataaaagtgaataagaaagcaaagaaaacccaatacaaaccctgcaagaagagagacagagaggtgaggaaagacaaaggaggaacggttcatagaagtctcgttgtagcctgggcccaaggtgctgtattcattggataaccatccacggatgcttactctgtaccaggtgtgatgccagatgctgggaatttggagatgactgagtcatggcccctgcctgagaatgagctctcagtttagtggagaaggcttacatgtaaacatataaattatagtgcagggtaattagaaccataatagagtaatgtaggaaacacacagaagccaaagaaaggaatgatgaattctatttgaagaggaggagctgggaggagaagagagctgaggccttcctgtgagaagggtgggtggtggtgcaggctggtggtggtcccctctgaataacctggaggttgccaggtgggcagaaggaggagagcattttaggcagctggagtgtgcatgggcagagttgaagattagcaattgcaggtcactgtgggcggagagcaggactccccttggcaacctggtgaagtcacttctgcccattactttattcattggaacaactaagagtgaacagaaaagcagcgctcatgccgtcagacccttcttccaaatgaaaacgtgcaccaaggcccagtgtataaataggaagcagataatgtttttttcttaacaggaaacagatctcccactgtttggaaatatattttgaaactttttttttttttttttgagacggagtttcactcttgtcacccaggctggagtacgatggcgcgatcttagctcactgcaaactccacctcctgggttcaagcgattctcctgcctcagcctcccaagtagctgggattataggtgcctgccaccatgtctggctaatttttgtatttttagtagagacagggtttcaccatgtttgccaggctggtctcaaactcttgacctcaggtgatctgccagcctcagcttcccaaagtgctgggattacaagcgtgagccaccgcaactggccaaaacatttttattattttattttatttatttatttatttgagacacggtcttactctgttgcccaggctggagtgcaatggcatgatcataactctctacagcctcaaactcctgggctcaagcaatcctccgacctcagtcctccaagtactgagactgcaggtgtgtaccactatgcccagctaatttttttttttttttgagatggagtctcgctctgtggcccaggctggagtgcaatggtgcgatctctgctcactgcagcctctgcctcccgggttcaagccattcttctgcctcatcctcccaagcagctgcagcagattacaggcatccaccaccatgcccggataatttttgtatttttagtagagacaaggtttcaccatgttggtcacgctggtctcgaacttctgacctcaaagatctgcctgccttgccctcccaaagtgctgggattataggtatgagccacagtgctcagccctcaaataatttttttaaattagttttttagtttttgtggggatgggtggggggggtcttgctatgatgaccaggctggtctcaaactcctggcctcaagctatcgtcctgccttggcctcccaaattgctaggattacaggcatgagccacaggtgtcggaaaccttctggatgggggtggagaggcagatccccaccacaggtctgaaattgcatcaaaactttgaaaagagggcaaagctgcttcacctgagagagggaggagctttcaggggaattctagatgggaggggagaaggtcacaccacatctgccatgcctgtctccactcttaccctgcccaagtccctcctccactttatcaaaatcaggagagagcaatccttctaaaatgcaaatatgagcatgtacccctctgttcaaaacccttccatgtctcccctcactgtgagaaaagaagccaaactcctccaggccgggcgcggtggctcacacacctgtaatcccagcactttgggaggccgaggcaggcggatcacgaggtcaggagttcgagaccatcctgccaacatggcgaaaccccgtctctactaaaaatacaaaaattagctgtgcgtggtggcgcatgcctgtaatctcacctacttgggaggctgtggcaggagaatcgcttgaaccagggagtcagaggttgcagtgagctgagattgcatcactgcactccagcctggtgacagagtgagactccatctccaaaaaaaaaaaaaagccaaactcctgaccacacctctcaggctctgcacactctgcccactggctgctgcccaggcctcacaggtcggcttccctcatttccctccagccaccctcctctcttcattatttccaaattcatcacactttcagcttgttatctatggcagataacctcattatggcagaaaataagactgaagcatgtgaccaaacatagacagactttttcacaagatagtcagtctcttgggcttattcaaattccaaagagaatcatttacaagttaattcctatctttcgggtccattcatttctccttttaaaatattttttttttgtttatttatttatttattttgagacggagtctcgctctgtcacccaggctggagtgcaatggcatgatcataactctctgcagcctcaaaatcctaggctcaagcaatcctctgacctcagtcctccaagcactgagactgcaggtgtgcaccactatgcccagctaattttttttttttttttgagacggagtctcgctctgtggcccaggctggactgcaatggtgtgatctctgctcactgcagcctctgcctcccgggttcaagcgattcttctgcctcagcctcccgagtagctgggattacaggcacccgctaccgtgcccagctaatttttttgtgtgtgtttttagtagagatggggtttcaccattagccaggatggccttgatctcctgacctcatgatccgcccgcctcggcctcccaaagtgctgggattacaggcgtgagccactgcgcccggctatttttttgaaacggagttctgcttttgttgcccaggctggagtgcaatggtgcaatctcggctcactgcaacctccacttccctggttcaagcgattctcctgcctcagcctcccaagtagctgggattacatgcatgtgccacaacacctggctgatttttgtattttttagtagagacggggtttcaccatgttggtcaggctgatctcaaactcctgacctcaagtgatccatccgcctcgggctcccaaagtgctgggattacaggtgtgtgagccactgcacctggccccattcatttccccacaaaatcacatactacctctcaacattgctgcacccccatttcccctcccctgtgaagaaggcagctacataagcatctggaccacgttgggttattaggtcatcgttctcctgtggtttccttatgcttgtacatgtgacataaattttgtacacatttttctcctattaatttgccaattgtcagttcctttttggggagcctttatagggctagagagcagaaaggaagctttcccttggccctacagctccttgaggtcggctgttgactcttttcttcattgctgtctcttcagcgtctagaatggtacctccaatgtagagatgcttgataaacgtgttgagccgggcacagtggctcacgcctgtaatcctagcactttgggaggctgagggtggatcaagaggtcagagttagaaacaagtctggccaacatggtgaaaccctgtctctactaaaaatacaaaaattagcaaggcgtggtggtggatgtctgtaatcccagctacttgggaggctgaggcaggagaatcgcctgaacccgggaggtggaagttgcagtgagccaagaaagggcagcagagcaagaccccatcttgaaaaaaaaaaaaaaaacaagcaaacaaaaaacaaaaacaaacaaaaaaacatgtgttgagttgctttctgtttagtagcagaaagctctggaagggctttggacattcacgcgtgcaggcccgggaacgggatgaggtttaaggcaacttcatctagagtttaaaaggggcaggtaggcccacagctggcacgtgggttaaatgtaaagtggctcaaacaggatctgataaggcagaagcagagatgggggcctggtgtctcactgccttcacgttcttccttctgcctcagtccccacatgagagtgcaccctagaggtgccagcattagcgatagggcagctttccttgtttctgggatggacagaaaatgggccttgagacccctcccatcataggaaagcatctcttgcactctggagactgaggacttgctatagtggaacaagaagcagtcttcggcaatggaggagatgctggatctccatacaggcagggtgggtgcaacggagtggagctgtggcaaatgtgggtgcctctgtcctgagggtcctggatgtgtcatgcctgggaacatgagggcgttcttccaaggtgcccatctcgacctctctgagctgccatctttgacttcctgtgtttggtcacagactaggggtggtctgtccctaaacagaagaagacaagcaaggattagagaggagaaagagctagagagagagcttgggagagatgtagggacaaggaaagaagaggcagaaggaaaaaggcatggagggaaggaatataaaaaaaaaccccttaggccaggcatggtggctcacgcctgtaattcccgcactttgggaggccaaggtgggtggatcacctgaggtcatttcaagaccagcctggccaacatggtgaaaccccatctttactaaaaatacaaaaattagccaggcatggtggtgggtgcctgtaattctagctactccggaggctgaagcaggagaatcgcttgaaccctggaggcagaggttgcagtaagctgagatcaggccactgcactccagcctgggtgacagagcgagaatctatctcaaaaaaaaaaagaaaaaagaaaaaaaggccgggtgtggtggctcacgcctataatcctagcactttggggggctgaggaaggtggatcacaaggtcaggagattgagaccatcctggccaacatggtgaaaccccatctctagtaaaatagaaaaaattatctgggtgtggtggtgcgcacctgtagtcccagctactcaggaggctgaggcaggggaattgcttgaaccctggaggcagaggttgaagtgagtcgagatcgcgccactgcactccagcctggcaacagagcaagactccatctaaaaaaaaagaaagaaagaaagaaagaaaaatcctccccagagcagggaaagatgaagacataaagggaaggagagtcaccaggaaagagagagggagagagacacaaaacaaaatggctggaatgaggtgaaagttatagtagcaggatgtgctgacactgaccttggagaaaaagagaggggaagggaggagtgaacgtggaatctttggctgctgttctgtttcactcccagaactcaccaccctggattccccccatttccagatcctcaggcgggactgcctttgctatctgggatgagtcattggccccagatggtaaacctgtgaggggtggggtgctctgaatgcctgactagtcatttataattgagagcacttattccagccccttctggtcctccatccttccctcttcttggacctcctgattcagagaggtcagagggccagtccaggaggggtcaggcactaggtccctggagtcagtcttagggattttaggcagagaggaatcagtcctgaaaatgaagggcatacagagaaaaaaaaaactatgacatcacccctgggggtgttacagacctaagaaagaagcaatggccctgggcggcctacagccccaggaagattcagccatggtacccaggagacttgagggcccaaagcccagaattacccccagaggaacacctgtagaccttcggatccttagctttgcacttcccattggactgactctgtttcctgtggggcaataggcacgtgttcactgtgcacctgcagccccagtcatccttctcagagagaaatggtttgggaagtgtttggcatattggggataaatagatgagtggatagaaaaaaaaatgcaggccaggcacagtggctcacgcctgtaatcccagcactttgggaggccgaggtgggcggatcacgaggtcaagagatcgagaccatcctggcaaacatggcgaaaccctgtctctactaaaattacaaaaattagctgggcgtggtggcgcatgcctgtaatcccagctactcgggaggctgaggcaggagaatcgcttgaacctgggaagcagagattatagtgagccgagatcgcgccactgccctccagcctgagggatagagcaagactgtgtctccaaaaagaagaaagaaaaaaaagcaattacagcaaaatattaaccatagtagaatctatacagtggttatataagtgtccactatacaattctttttttttttttcctttttttgagacttgatgtttcgatcatggctcactgcaactttgacctcctcagctcaagtgatcctcttgcctcagcctcctgactagctgggatcacaggtgtgcaccaccatgcctggctaattgttttattttttgtagagacgagatctccctatgttgcccatgttggtcctgaactcctgagcttaagcagtcctcctgctttgacctctcaaagtgccgggattacaggcatgagccactgcacccagtcttgctatacgattcttttgttttttttttttttttttttgagatggagtctcactctgtcgcccaggctagagtgcagtggagtgatctcagctcactgcaacctctgcccctcaggttcaagtgattctcctgcctcagtctcctgactagctgggatcacaggcacctgccatcacacccagctactttttgtatttttagtacagatggggtttcgccatgttggccaagctggtctcaaactcctgacctcaggtgatccagctgcctcagcttcccaaagtgttggattatgggtgtgagccactgggcccagccactgtacaattctttaaacttttatatgtgtttggatttttcataatattagaaaagggaaagaaaaaaatgtctggcaaatagtcagcactcgtaagtataagattttgggaatatattcccttctgggagaatccacatttcgaatgcctgggaagggctctgtttgtcctgacagatggcagatttcaggtgagagcacctactaagcctagaggtgataagctactttgcccacctagagctgctggtggtgaccttaagtttactatgtttctcctggtatacggcacttggcccagagtggactccagcttgccacctgtcacccaggctggagtgcagtggcgtgatcttgtctcactgcagcctcaacgtcctgggctcaggcgatcttccctacctccctcctgattagttgaggctacaggtgctcgtcaccatgcccggctaatttttgtttttgttttttgttttggtagagatggggtctcacactcttgcccaggctgagctagaactcctggcctcaagcgatctgcctctgcctcccaaagcattgtaatgacaggtgtgagtcaccatgcccagccaggaactcagagaatcttaccctatgctgtagtatctgttgactatggggtagaggcaggataaggtgttccagaccctgcctgacacctgatccgaagaggttgctcatgtttgctcaggaggtgaggttcacacaataaagggcaggaggagggcttggacctggtataaaacatctggaagtttccagggggctgctttgcatctgaaactgtcaggtgaggggtgacagagatgcctgaatctgagttgggggggaattcaaatctgagctggcgaagaggatgcctggaaggaatggcaggaaagacttgagttaattggcgcttctgggtctgcagtaatcttaggtgcaaagctgtctaggtctctgctgaaggactggggacacctgggatgttcaggagaatagaaatggccagatgtgtgttagtggagaaaagaatagtgacacatagaccaggcacctggggtctaatatcttgagctggtcccgactccttctgcaacttctctgtctgtcctagttccaccagcactgcttggatactggtgctggcacagttccttctgtcaccaactttgctccccaggtaacatagaggcaactctaaaatgcttctttccttgagaccaggtggatgccagggatttaaaccatgctccaggtgccccataatccaggccaattcaccacagatgatgaggctttctttgctcagcctctgggctcagtaaactcagccatctctttgcttgggagaggtcctctactccctccttagaaaactcgtttcctggctatggccataccaacccaaatgtacctgggcttggctgacttcagaaaacttttctgctttgtgccaggatggaataaggcttaatccagatagttagagttcatcttcaggcctgagagaaaaagaggagggcttggctacagccagaccagggagagctggaggggtcagggacattgaaggtagcatcagagaggaacaggactacaggctatggacagtcctttctaagctcaagactgggtctgctaggtctaagttgaaggacgaagaaggcttggtctgagctgcaggtcaggagtgcctgggtcaatcaagtcaacaaggaagaaggtgaatcttcatttgctcttttcttcccactccagccccagaatgttgacagtcgctctcctagcccttctctgtgcctcagcctctggcaatgccagtaagtgagataccaggagcctggtattggggacttgggaaggcagccttgggcactgctgttggccaaggcttttggaggttggcttggggtggggagctgagttgtcggaggaacaggggtgatgcagagaaactgaactcctggaagatttctccctccaactcctgcttgcccctccagttcaggccaggtcttcctcctatagtggagagtatggaggtggtggtggaaagcgattctctcattctggcaaccagttggacggccccatcaccgccctccgggtccgagtcaacacatactacatcgtagggtaagattctttgaattcctggctgggcgcggtggctcacatctgtcattacaatgctttgggaggcagaggcagatcgcttgaggccaggagttctagctcagcctgggcaagatgccagggatgccagggatttaaaccatgctccaggtaccaagaccccatctctaccgaagaaaaacaaaaaaattagccaggcatggtggtgagtacctgtagcctcaactactcaggagggagaggcgggaggattgcctgagcccaggatgttgaggctgcagtgagccaagatcatgccactgcactccagcctgggtgacagagtctctttgttggcaaaatgagttgaagttccctgtaggatcttccagggttcacccaggcttcacagtctgtaggactagccagagacctctcatccctatcatcacctttctttctccttccttcctcccctcttcctcagtcttcaggtgcgctatggcaaggtgtggagcgactatgtgggtggtcgcaacggagacctggaggagatctttctgcaccctggggaatcagtgatccaggtttctgggaagtacaagtggtacctgaagaagctgttatttgtgacagacaagggccgctatctgtcttttgggaaagacagtggcacaagtttcaatgccgtccccttgcaccccaacaccgtgctccgcttcatcagtggccggtctggttctctcatcgatgccattggcctgcactgggatgtttaccccagtagctgcagcagatgctgagcctcctctccttggcaggggcactgtgatgaggagtaagaactcccttatcactaacccccatccaaatggctcaataaaaaaaatatggttaaggctagtctgtgtgggggcatctgtggctgggatatctgcctcctgacttagccggggacgtgcaaatctcacttctggctggctttggacatctgtctggaagatgggaagatgagggagaggtatgtaagaatcctgggctttgtgctataatttatcaagaggagatgagattctggcttgcatcaacgctcttcaaggacagctccttggaacattgatccaaactggagtcatgggtctgagggcaaggcctagttgtggcttacaccaaaaccccagatgtcccactctccagctctcctcacccctggtcctccccttgagaaagtggtgaactcacttgctgtgtgtgggtggccaggaccattagcctttgttctttcccagaacccacctgactcctgaaacttagctgaagtctgtgcccgaggaccctgccctgttaccaggcccagttcctcctcacctctacccatgagccccggtgtcctgctaagccctctcagatctgggattcctccttcctcaggaagccaccaccttctcagcagtggaaaccctgcccacactatgctcttaggctttagccatcagaaggttacagtggactgcgggaggctgacactaggctgaactcattaaggaatgaatgggaggtgagaagacacaggcagcaagaatcgagtgtttcaagaagtttggctgtggtttgccagaaataggcaagtcagttttcgggggtgtaaggaaaaagggttttgtgtctttttaaaatcctagacaggagagtcacaagcatgttcacatgataaagaggaagaaagagaaagaggctggagattctgaaaagagatcactggtgaggtctcaaaagagatagaagaggatggttatgtagttggggaaagaaattttaagaagggaagaaaattaaaatgagtgaaggtatacgttagttttgtaaaagttatcaatatctggctgggcacagtgctcacacctgtaatcccagcactttgggaggccaaggcaggcagatcatttgaggtcaggagttggagacaagcctccaacatggtaaaaccctgtctctactaaaaatacaaaaattagccaggtgtggtggcagtcacctgtaatcccagctacttgggaggctgaggcatgagaatcacttgaatgctggaggcagaggttacaatgagttgagacagcacaactgcaccccagcctggatgacagagtgagactccatctaaaaaaaaaaggaatgttatcagtatcaaaatggagtaacatatgtcacatcctaacaaaatggaaccaacctgacacctaaattaagcattgcacctgataacaccatggaggactgggtggagaatcagcagacaatggcagggagaggcagtctgtggaccaagttcaggtgaaaggatcacccatcatgttgggcatcagatcaggcaggttcacacactacctgaggaagctggtctttgtgacagacaagagctgctctgcctcttgggaaacacaggcaccagttttagtgccatcttcttgcacccaaatgctgtcctttaactcatcagttacagtgctggatccctcatcactgccaatacggggctagcaatatgtctgccccagtgaatgcagccgccacggagccccagcctcctctatggcaggggccctgtggtggggaatgaggacttctctatcattaacctccatgcagttggctcaagaaaaggatatggtagttgggcaagggggctcacacctgtaatcccagcacacttgtaatcccaggagggtcgcttgagcccaggagtttaaggccagcccgggcaacatagcaacctgtttgtaggcaaaatgaggagttgaagttccccgtaggatcttctagggctcaaccagccttcatgtgcagtgggactggcaagaaatctgtcatccctgttaccactttgaaggtctcagtgtgtatgcaggtcctgaaaagttcaagtcccacctgaaacgcaacacagcatcatgctctgattcatcagtgattccctaatcaatgccattggcttgcattgggactatctatcccagcctatccagtgacttcagcagctgcagagccccagcctcttctttggcaggggcactgtggtgaggaggaaggattcccttatcacaaatctccatccaattggttctataaacagatatggtggcccaactgttgcgggaagtcagggaccccgaacggagggactggctggagccacagctgaggaacataaattgtgaagatttcatggacatttaccagttcccaaaattaatacttttatactttcttatgcctgtctttactgcaatcactaaacataaattgtgaagatttcatgaacatttatcagttcccaaataatactcttataatttcttatgcctgtctttattttaatctcaatcctgttatcttcataagctgagaatgtacgtcacctcaggaccctgtgatgattgcattaactaacaaattgattgtaaaacatgtgtgtttgaacaatatgaaatctgattgtaaatgtgcatttgaacaatatgaaatcagtgcaccttaaaaaagaacagaataacagtgattttagggaacaagtgcagaggttacaatgagttgagatagtgcgactgcactccagcctggatgacagagcgagatttcatctaaaaaaaaaaaaaaaagaatgttatcagtatcaaaatggagtcacatatgtcatatcctaacaaaatggaacaaaaagggaagataaccataaggtctgactgcctgcggggtcgggcaaaaagagccatatttttcttcttgcagagagcctataaatggacgtgcgagtaggagagatatcgctaaattcttttcctagcaaggaatattaaatattaagaccctaggaaaagaattgcattccttggaggaggtttacaaatggccactctgggagtgtctgtcttatgctgttgagataaggactgaaatatgacccggtctcctgcagtaccctcaggcttactaggattgggaaattccaacctggtaaattttggtcagaccggttctctgctctcgaaccctgtcttctgttaagatgtttatcaagacaatacatgcacagctgaacataggccctcatcagtaattctaattttgccctttgtcttgtgatctttgctttgccctttgccttgtgatctttactggcctcagaagcatgtgatctctgtgacctactccctgttcgtacaccccctccccttttgaaatccttaataaaaacttgctggttttgcggctcaggtggggcattatggacctaccgatatgtgatgtcaccccccaccagcccagctgtaaaattcctatctttgtactctttctttttatttctcagaccggccaacacttagggaaaatagaaagaacctacgctgaaatattgggggctggttcttctgatacccaacaccatggctcacagctgtaattccaacacttccagaggccaaggcaggaggatcacttgaaccttggagtttgaggttgccatgagctatgattgtaccagtgcactccgacctgggtgacacagtgagaccttgtctctaataagaagaaaaaaatgccattttaaaagtgtacactttcatggtttttagtatattcactgtattgtacaaccattaccactacctcattccagaacacttccaccacccccaaaagaaagcagttacatctgttcactgtagtgccaattactcaaccccttgtcatcccctggcaaccaccactcaggtgtactttctatgtctgtgggtttgctattgtaatttgaaagttcactgatgttactttaatttggtttcattttgaatacagtaaatatggatcaaaacccatatatacggagcatctttagaggcctcatttttgtttttttttttttttttgagatggagtcttgcactgttgcccaggctggagtgcagtggcgtgatctcggctcactgcaacatccacctcccagattcaagcgattctcctgccccagcctccccagtagctgggaatacaggcgcctgccaccacaccctgctaatttttttatttttagtagagaggggttttcactatgttggccaggctggtcttgaacgcctgacctcgtgatgcacctgcctcggcctcccaaagtgctgggattacaggcgtgagccaccacgcccaggctagaggcctcattttttaagactaatgggatcccaaggctaaacgtttgagaaacactgatctaagatttgtgttttgttttgttttgttgttcaatcaagtggaacataatgtctaaaccagggccttacctacctggaactcaaaggtggaatgaccttccctggccaagcttccagaagggacagggagctacttaacagactgctggacccttaacgactggaaaccggaaccgtgggtgacggaaccgaccagacgtgacagccctttggctggggctgcagtcccacgatccacacaacgactctggctccgcagacgcgccaaccacccacggaggcaagaaactgccgagagtgaagggaaagggagcccagtgctgggcggcactcagcagctcccccagcggccactgtcgccaacgtctccgcgtcggggtttgtaccgcagctcgcgtccagtcgtcaatggctgcgaggcccatgcgcgctccagcgtcctgaccaggggaacgttttccttagggacccggaggcgagcgctggagggagggatggttgctaacgcaactctctgcagggcagacccaccagcacccgcacgcaaactacgggctggagcagtctaacagaaactctctcaaagtcgctcacgggttgccattctaggtaagatttgtgaataaaactaattctttaaaagcctgagtttttctttagttgacagttttaattaacatactcttttctttcctcttctgcagacccagcctcaccattccaatgaagacatcaattaacccatgcacagccgctacaaacggggagctcattgcctgcagggaaggaccctctacagagagctacctgggggctgggaagcaggaccccaggctgagtcctgccttttggtagtgccccgccccggccaatgcggctgttatatcaaagtacataaaagtgaaggcaaagggtgtccacgtgggatagactggcatagcttcctggccacccatggtgctccattatctcttcgaggaccccttctccacgagaccctccaggtctggtcctctatcgtccagcccccattctcttctccatcactgctgctgtgtcccagatgaccttaatttaatcttcacatatttgaaggacagaatcatcggcctcacccactaattattattattattattttattttattattattattttttgagacggagtctcgttctgtcacccaggctggagtgcatcactgcaagctccgcctcccaggttcacgccattctcctgtctcagcctcccgagtagctgggactacaggcgtccgccaccacgcctggctaatttgttgtatttttagtagagacggggtttcaccgtgttagccaggatggtctcgatctcctgacctcgtgatctgcccgcctcggcctcccaaagtgctgggattacaggcatgagccaccgcgccaggcctagacccactaattatcttttatggcacaaactctatgttttacttttgcccaggctggaatacaatagcggcatgatctccgctcaccacaacctagcctcctgggctcaagtgatcctcccacctcaacttcccaagtagctgggagtacaggcatgcgccaccacacttggctaattttaaaatgttttgtagagaagggtctcactaggttgcccagactggtcttggactcctagacccaagctatcctcccaccttagcctcccaaagtgctgggattacaggaatgagccactacatctgacctcctttgcttcttttaaagacatagtttggaatttttttttttttttttttttttgagacagagtctcactctgtcgcccaggctggagtgcagtggcgccatctcggctcactgcaagctccgcctcctgggttcacgccatccttctgcctcagcctcccgagtagctgggactacaggcgcccgccccacacctggctaattttttgtatttttagtagagacggggtttcaccgtgttagccaggatggtctcaatctcctgaccttgtgatccgcccatctcggcctcctaaagtgctgggattacaggcgtgagccatcgtgagcagcctttttttgaggagtctccaactgtcacccaggctggagtgcagtggtgccatctcggctcactgcaagctctgcctcccgagttaacgccattctcctgcctcagccttccgagtagctggaactacaggcacccgccaccacgcccagctagttttttgtatttttagtagagacggggtttcaccgtgttagtcaggatggcctcgatctcctgacctcatgatctgcctgcctcagcctcccaaagtgctgagattacaggcgtgagccactgcacccggcctggaagttattttttaaaaatcaattgtttctttctctgtcatcccagcaggagtgcacaggcatgacctcagctcactgcaacctccacttcctgggttcaagcgatcctcctgcctcagtctcccaagtagctgggactataggcacatgccaccacatctggctaattttttttctttcagatggagtcttgctctgtccctcaggctggagtgcagtggtgcaatctcagctcactgcaacctccaactcctgtgttcaagtgattctcctgcctcagcctcctgaatagctgggattacaggtgtgtgccaccacgccggggtaatttttgtgtctttagtagagacagggtttccccatgttggccaggctagtgtcaaactcctgacttcaggtgatctgcccgcctcagcctcccaaagtgttgagattacaggcatgagccaccacgcctggccaaaccaccctaatttctaccagccagatgcagatccttaaaacaaccctaggaggtatttcaaccattattcccttttaatatctgaggaaatggaggcacaaagaggctaaatctctggtctgggcagcctggcaccaaggccctgtacctaaatggtttattcaaacatagaagccctatctccttgatctatgctcttttcactatttctggcaggtttcttaccaaatatctggagttgacaacaaatgtgaaaactgaacagccttttctgacaggcaaggaagaccaaactgccaattgccaatgtcagatgttctcaaagtatggtccagagacttctgggagtccctgagacactttcagtgggtctacaagttcaaaactattttcataataaaactaagataccaattgacttctcttgcattgtttctcaagtatatagtggagtattcaaaatactatattatatgtgacatcacaacagcatgaatgcagaagcagatatgagaatctagtttttttgtgtgtctttgagacaaggtctccctctgtcactgaagccagagtgcagtggcaccatcacggctcactgcagcctcaaactcctgggcttaagcaatcctcccacctcagcctcccaagtagctgggaatataggtgtgtgccaccatgcctggctaattttattttttaagagatggaggtaggccaggcacagtggctcacgcctgtaatcccagcactttgggaggccgaggcgggtggatcacgaggtcaggatatcaagaccatcctggctaacacggtgaaaccccgtctctactaaaaatacaaaaaattagccgggcgtggtggcaggtgcctgtagtcccagctactcgggaggctgaggcagaagagtggcgtgaacccgggaggtggagcttgcagtgagccgagatggcgccactgcactccggcctgggccacagagcgagactccgtctcaaaaaaaaaaagagatggaggtctaggcagggcttggtagctcacgtctgtaatcccagcactttgggaggccgaggcggatggatcacctgaggtcatgagttcaagaccagcctgaccaacatggagaaaccccgtctctactaaaaacacaaaatcagccatgcacggtggtgcatgcctgtaatcccagctactcgggaggctgaggcaggagaattgcttgaacccaggaggcggaggttacggtgagctgagattgcgccactgcactccagcctgagcaacagagagagactatgtctcaaaaaaaaaaagtgcacacctctctggtttttagtatgtttattacgttacgcagccatcatcactacttcattccaaaatatttaatatttccatcacccccaaaagaaactcgttatatctattgctgtagtgccagctcctcagcccctcaccatcccctggcaaccactacttagatgtcctttttatgtctatgggttttttactgtaatttttaaattcattaatgtcaactttaatttagtttcacttcacacacagtatatacggccaggcctggtggttcacacctgtaatcccagcactttgggaggccaaggcgggtggatcacttgaggtcaggagtttgagaccagcctggccaacatggtgaaaccctgtctccataaaaatacaaaaattagctgagcgtggtggtgcacacctgtaatcccagctactcgggaggctgaggcaggagaatcacttgaacccaagaggcagaggttggagtgaaccgagattgagccactgcactctagcctgggagatggaagtgaaaccccgtctcaaaaacaaaaaaacaaaaaccctcatatacacaaaacatctttggaggcctcatttttaaaaactgtagtgggatcccaaggcaaaacgtttcagaaacactgatctaagatttgtgttttttgttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggtacttgagcccggcctgggcaaggcgggtaccgacgtctggagtttagtgggagttatgtgtcggagtgtggtccaggctctgcgggttgtcgcggagaggcggccatggcgcaggggcggggagagggggacggtgagagtgtggggtcgcgagccggtcgccccgcctggctcctgccttctccctgtttcctgctctccccttgggtcagtagactcgggtctccggtccaggctcttggcttgaaccccgcgcactttttctttgtgagcttcggtttcttcgtctgtgaaacgggggtcatggcctcatccctggagatcacctgaataagcaagagaagagtggcggacgctctagccacgaggacgagaagaagggagccggaggcgtgtattgggaagggttctgtgtgggacatggtgtttgggtgcagagacatccctgagagatgcaagaggacgggctgaggaacagacccggctgctgctgggtttgagttggcagcgtaagatgctctgcgattacaggaaaacgaaataaaagactaaaatttcctttcactctagcatggaagtgaatgctattttagggttggaaaggctgttaggacacccaaaatcttgtatgtgagtatttgtttacatgtgcctctctaacccggagacttaatcctcgttagtgatgatggtgagcgccatagtaattcactggagccctcgttagcctcgtggggaaacagacatttaggagaatgcctaacacatgtagagctcttgctatgtgccaggcacagttgtaggcattttatggtggtgaaccatttattgtccacacaatgctatcaggttgttactattactgtctttgttttacacaggaaactgaggttagtttgttcagagttaacacaactagtaaatattggggcttgaattcgctctcaaggagtctgagtgtagaacctctgctcttaaccattatgcccaagtacatgttatccctgctggctgagcacagtctccccttacccttcgaagatgcactgtgtccggtgcatggtagatatgaaaatgcctgaatgaataatgtcccttcctcgaggaatttacagtctgtttcaatagagtgtcacatacgtagatgtaatacgaaacacaatgagagatgtgtataaactgagggtgtggaatctgaagtaagcccttgagtattctgggaggacttcattaagggagtgaatgatacttgagatgggtttcaaaggttggataggagtttgccaggccttgactaagaagacaagaacagcaagtgttttcttatttatgatgtaagatgctctcttagctcaatttcctcatcaataaaagggagaagagtgaatgaaatttaggaattgtgaaagaagggaaaattaataattgctagcctggtccaagctcaaggttgcttttatcatgaaagggctagactcttgtgcagtaaataattgtttacatgtggccctcccctcttccctcctaccctggactgtgagccctggggcaggaatggccgtgagccattttcatgatggaaatgaacaagccagtgattagtagtttattcactaaatcttaatttttttcagcaaatacttcttgagggcctactctgcgccaggtgttggggttagaaaggtgagcaggataaaacttgttctcacagttggcagtcaggtggagaaagtgacaaacacgcaatagtggggtgtgacaaatgcttatggaggggctaacatgagctgtggttgcacctgataaagccttagtgtctaccaggaaagggtttttggttttgttttttaagaggagttaaaatgtgtttaccttagtcactccagggtggggtggggagcaatgcagatattctagggagagagattaacgtggacaaaaatccaaaggtgcaagagaacttggagttttgtaggaagtgaaggaaattcatcatgactggtaacttacactgcaaggaaggaaacagagggaatgactagagggcagggagacaccttgctaccaccagcaaggaaggctgtaaagaccatgaccttgggcagaggtagtgcagtgggagtggagagaagtggacttgttcaagagagatttaaagagatagacttgacagatgttaatgatgaactgatgtgggaggtaagagacgttggagttaaagactcccacttttggggttggtgccattcatttacatcagagatcaaaggaggaggctgcagagagatggggaaggagggttcagtttaggacaggtggagtttaagaggagccgtcggctgggctcacgcctgtaatcccagcattttgggagaccaaggtgggtggatcacgaggtcaagagatcgagaccatcttggccaacatggtgaaaccctgtctctaaaattaatcaaaaattagctgggcgtggtggcgtgcacctgtagtcccagctattcgggaggctgaggcaggagaatcgcttgaaccgggaggcggagattgcagtgagccaagagcgccactgcactccagcctggcgacagtgagattctgtctcaaaaaaaaggagccgtcagggcagccgttcagaacgtgggctgcagttgagagctcttgtgcagaacgtgcaataggacttatcagctgtaagatgttactgaagccaagagggcgggtgacctgcctatgaaatgaatctgagtggtctcagctcggggcaactttgtccctcacaggacatttggagatgtctggagagatttttagttgttacaacttgagggtgagggtggagaatgctactggcatctagtaagcatatgctaacagtctaaatgcacaggacagccccacaacggaattagccagcccgaaatgtcagtagtgctgaagttgagaaatgctggtctagagaaaggatagacggatcctaggatgaggagtgaacagaaaactaggtaagacaaccaggaaggtggggggcatggaaatgaagggaaaagtgtgtttcccaagagtgtcgcatacttctgggaggtccaacaggattgaggctgagtatgcctactggatctagcactagggaagtcatgggtgaccctgctgaatagtgagggcagaagcaagttgcagggatggaggagtgggtagcaagagaaagggtgtaataataacagctaaggactgagcagttgctgccaggcactgtgctaaacattgtatgtacattattactttgaatcctcacattcttatgagatgcaaagatgaaggggctaaggaggctgaggagggttcatataaagcactttggagttagatcttcatttgaagctgtcagtcactagctgttgaccctgggtcagtcagctaacccctctatactgaggtttcctcatctggaaaatgggagacggacattaaaaagcacttactggcctttcaccaaataccagataatgttctaagcacttttacatgaatcaccttaattactctcctaacaacctaacaaagaggtatttttattcccattttgcaggtaaggaaattgaggcactgggatggaaaataatttccctaggttacttagctagctgtaaatggcagagctgggatttcaacccaggccattttaccttgaatgatgaacctacctactatgtgctagtcactgtgctgccactttatctggcacttatttcaattatcttttttttttctgagacacagtcttgctctgtcacccaggctggagtgcagtggcgcaatctctgctcactgcaacctccacttcccgcattcaagcaattcttgtgcctcagcctcccaagtagctgggattacaggcgtccaccaccatacctgactaatttttgtatttttagtagaggcagggtttcaccaccacgctggtctcgaactcctgacctcaggtgatctgcccaccttggcctcccaaagcgctgggattacaggcatgaaccactgcgcccggccaaattctcaaaaagcccaaggcccacccccaaccttattttacagacaaggaaaccaaggtccaaggtcacaagctaataaatgtcagagctggaattgaagtccacttctgtctgaccagagtctacactctacctcattactgacttccccttccccttagattgatcactgcgcttccttaagtgcttctacatctgccatctttctgttctcccaaaacatcctgtgaaagcaggcagaggaaggtcctgcacatatttttgacaagtcagtgcacctcagttttctatctgcacacatgcatctgcaggtttttacctgcttgctcctgactttcaggattgccatgaggaacaaatgagaactagatgtccaagcgctttgctaccataacgtgagaaatggtattagtagccccatttatcagatgatggaatggaggttcagtttttgaaacagcccgtctgcttatgggcatgccttacttaggtgtaagattctttgtaggggtcatctgtctgccttttcgtcttgctgtttctgtgttggctacgtataccagccagccttttgccttctgcgaggcctatggctcctagcaaccagctgctaccaccagcaaggaagggaaagagctgccaggagctttcccagttggtacataataaggaagcaatacagcatcctattaaaagcagatttttagaggggaagagatctaggtttgaattccactatgagctacagtatgttatcctccaacgtaaaatagagtaatactctccttagatattttcagctcatttaacccccacaaaaatagagggcttttctttttttaagttttatcttcattgtgttttctgatgataaaaataattcagttgccaattctaaaacaaaacaaaacaaaaaaaacttaatcatctgaagcaaattcagggttaagtttacatgagagaagaattgcatgtcggtggtttttgcagaacccacataattccccatcaagagaagatcatcattaacagtttgcaggggtgggtgggtctgtgagtatacatacgtctcaatacatattagaaaccccagttaagaaatggaggtacaggctgggcagggtggctcacacctataatcctagcactttgggaggccaaggcaggcagatcacttgaggtcaggaatttgagaccagcctggccaacatggtgaaaccctgtttctactgaagatacaaaaactagccaggagtggtgttggggacctgtaatcccagctactcgagaggctgaggtgggaggatcgcttgaacctgggaggtggaggttgcagtgagctgagatcatgccactgcactccagcctgggtgacagagcaagactgtctcaaaaaaaaaaaaaaaaacacacacacacacacacacagaaaattctggcagttcgctctctggtttaggtttcggtcagatgtcaacccttttaatccttagaacaaccctgtgaggtgctggtctacttcacccttggcaattcaaaacatgtcctgggccaggcatggtggctcctgcctataattccagcactttgggaggctgaggtaggaggatcgctggagcccaggagttgaagacaagcctgggtaacctagtgagactccatccctctctctctcttttttttttttaagtgcccagcatcacctgggagcttgttagaaatgcaaaatctcgggcatcaccccagggagacggagaccaaatccacattttcacaagatcctccaggttatttgtgtatacattacagtctgagaagcctgctatacacctgctgcacttgcttgtagagcagggaaggcactgaggccaagcttaggggtgtccacaacatgaccagggcagaatgagcttctccaacatgagctgtggcccccagcccgcccagcaaagttggtccctgcttcttctgctaccaccatacttcatgtctaaaagtgatcttctctcctccaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtaaggttcaggccactcctcttccctcatgccatcacctccctctcctaggcctgcccacgttcccctgcctccccaggatccttgctccctccttagcaccgctttgttccctgagccttcactgttcacttaggaaatgttgacaggtgcccccatgatgggccctctctgggatactgtagggagagatgagaggttgaatcaaacatacattactgtgcacagagagggaggagcaatgagggtgagcaggtgagccccaagtagaggctgggggacatatcaggagggttggcggaacacagacctgccagccagcctacccaagctgcagctgggtagtgtcagagaagaccacccagatttggggacagaactcagaagggcagctactttataatcctactggggatttaaagttcaaactccttggcctgtttttctaggcgggggctggcaaaccatggcctgcaggtcaaatctgatcaggagtaagattttcagtaaataaaattttatcgtttatttacatattgtctatagctgctttctgactacagtggcagagttgagtagttgtaaaaggaacacatggcccacaaagcctaaaatatgtacaatctgcctttttacagaagtttgctagctcccatactaggccgttaacaatttgggcttcagtttctttccagcctcattccctcaatatatattaaactccctgctgtggcctaagctgcacttctccaccagaacgcagtggataggtgattggtatgtagagtctagttcagtcataagcagcatcctctattttccccattatggtgtaaaatacaatgttctacacatgtagccatttgaaaaagactgggaagccttgcttttttgctattcttgattctcagaatttctttctttggtcaaaatcttccttccttgagcagaatcagttactcctttgagagtgtgttcttatcttcgtttcctaaatcacagcaaagtgtggatatctatcctaccagactgaaaaactccaagagcagggatatcagatctatctctgtattcctaacaccaatagagagatgaggatggagtaggtgttaggtggatgctttttaaggtctttgtacaagaaaggggatagagacgttctcttaaatccaaggtccagatgagagtagaatcccttacccacccccaccccactccaccccttacacacacacacacacacacacacacacacacacgctaatttctttctttcttcctgcaggtttgatgccttctatggggagaggagtactcagcaggacatctatgcaggttcagtgcagcccatcctaaggcacttgctggaagggcagaatgccagtgtgcttgcctatggacccacaggagctggtgagggagccagaaaagaaacagctatgggtcagaaagggctggggaaacggagaggaaaacctcacagttttctccactctcttcccagggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtgaggccccgtgctggttgggagaggagcaacaaagggtcaaagtaagacctggttctagaacatgaagctctgctgtagcagggaggtaaggtgagacctagaaagacagagactggggtagcagatggtacaactccgagaatagaacagagaaaggaaactgatccccaggaagaaacagcctctctatggagaattgcccttccccttcactgcttacacaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtgaggccgcagacaggggcgaggacctgggaagcccaggagcctgagctaagcacgagacctttgttcttacccccaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggtcaggcccacctgtctcagggaagaaggggctgcagaaggaggttctcaggcctgctgtggggtggggaatagcagttgaggcataggaaggctgggcttctgacccacccactgcctggtctcaccctcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatggtgagaactgggggaggcaggagtggaaacgctgggtctggaaattagggagtttgttgaaaccaccaagcatcagcacagaggctgaccacccccaatccctctctccaccccatcctccaatcatctagccttgggacctgttaagctgtctcagaaagaattgcttggtccaccagaggcaaagagagcccgaggccctgaggaagaggagatcgggagccctgagcccatggcagctccagcctctgcctcccagaaactcaggtgagcagtggggccttgggtgtatccccttcctgatgtatggcttagcagcagagctgcaatgcccgtcagatccttgagcagagagctgtgatcttgttcctctcccattaaattcaccctaggccggatgcggtggctcactcctgtaaccccagcactttgggagactgaggttgggtggatcacctgaggtcaggagttcgagaccagcctggccaacatggtgaaacctcatctctactaaaaaatacaaaaagtagccggatgtggtggcatgtgcctgtaatcccagctacttgggaggctgaggcaggagaatcccttgaacccaggaagcagaggttgcagtgagctgagattgtggccattgcactccagcctgggcgacacagcaagactccgtctcaaagtaaataagtgaattcaaccctggctaggcacggtggctcacgcctgtaatcccagcactttgggaggccaagacgggtggatcacctgaggtcaggagttcaagaccagcctggccaacatggtgaaaccccatctctactaaaaatacaaaaattagccaggcatggtagtgggcacctgtaatcccagctactcaggaggctgaggcaggaagaattgcttgaatctgggaggtgaaagttgcagtgagccaagatcatgccactgcactccagcctaggtgacagagcaagactgcatctcaataaataaataagtaaataaataaattccccccaaattctactccattgaatcactaaagtctaagattaatctctcctcagtgctgctgccttggggacctaaggaggcctcctcctggggatcctttccattttccaacccctttagccttcagcaaaacttctcactttgggacagctgtttcaaggatgagcatttttgcttctggttcaaggagtgatctggatcagatctttcagatccatgagagcaaagcaaaggagacttggaagagctgtcctgctgagaccatctggtctgtgtgtcagtgcccagcttctccatgactctccggggagccagctgctgtcctaactgcgtctaccctcaatccagataaagcctctaaactaagtcctttgtgtcacctcctgccccaactccaatcaccccacctcatggcccagtatgtactaatcctcaggtcatctctgttcaggggtcttgctttctgtgtctggccacttagcccttgcgctattccctccaccccccaggagccagttgcagttttaactttgccctgtttctacccctagcccaaataaagcctgtgaactactaaacagaggtgacctgaggtggccaagggttagtgcccactctgtcccagggggctactgtagttaaggaagatgccacacacaagaagatgcttgtgcactcatgaccccatctctcagtcttgtctttcccaaaccatctgtcagcactccccactgctgtgtgcacccagaaatgtgcacaggtaagctgtcagacaggcactctgagtaaggggaagctcagagttgggcacatcaaacccagcagacccagagcttgggggcctcacaggagagcaagtcagatgggaacatcagtatatgataccaggtggagaattcagaatcaggaaggagtagctgctgctgctgtgagagtcaggaaggaagagatgacttctagtgtttgcccacgtatgttctgatcctgtttttccaaggcactagcatggaaagcacaggagtgtccctgtcctccaggagccagttcacagcataggaagggagatgcattgttaagcttggcgtcatgggaaaggtggcatcaaactgacctggaaagattattgatacagatgtgaggaggtgtggggcaagattccaggcaaaataaatgaatgttagacgttgctgactgggcgcagtggctcacacctgtaatcccagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgcttaagcctcaggaggccaaggctatagtgagctgtgatctcaacactgcactccagcctgggtgacagagcaagaccctgtctcaaaaaaaaaaaaaaaaaaaaaaaaagaatgttaagccttaccgtgctcagagtcagtcaggactgcttgaacaggccttcccagctgcccacagcagggaagcttggcagctgaggtcttcggtggatttcaaagccctgctaaagatggcatcctctgtgatgttttccgcaactgctcctccaaatggataggcactgtcctggctgtcaccttattatggtctcttgatttcctcagtagacagtgcctccagggcagggcagtgtcttaggtctctcatacctggcactcaagtgttcgcctgatttcctggcatccccgagcagtcacttcacctgatgaagacactgcacccagagaaactggatgcctagcaagttaacattaggttctggagctacaggatataccaagttaaggtgtggtgaggggagtcctgctgctgtaggtggtgatgagggaggaggtaggtggggagcaacttctttttctgctcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgaggtacgtgttttagggatgtgggagctggattcctattggccttgagaagcaatccttggatcttcagacagggaaggacactcaggctggactagagtccagttttctcccaataccggaagttctccagcttctgcttgaatgtccttaacatggctgaactttgacagacaattgagaccagatgtgagggtgagaagaaaaagttcaaagtaaaagcaacaaatgttaaacattacatttcctaaagcccagctcaattaattgaggactgtgcttgaaaagcctttcccttcaatatttgcagaggcttgttccacctctgggtagccccctaatcacagaaagcccttaattatgttaggctccacctgtctcctggtaacctcccactggtcctagccctgccctctgggggctcagagccttgcatactcaccctggtaacccactcccttcaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaagtaagtttgactccaggggctggggggccaaggcagctgagatcctataagggaggaagtgttaggagcagctgtctccatgtcattcatattctcccaccacataccagtcccagggaggggtgaggaggctctgaggcagtgctgggggtgctctgccctcgggtgtttaggacagtgggatggacaaacgagtagaggattgaagataatgcaagactgactgaaattcctttaaatgcgggtataaaaaaggtcatgtggaaacacaacaggttaactctggatggaggggagctggggaatcagaaatggaagaatcgaagggctaccagggagggtgaaaagtaccctttgccctgactccaattctcgattcctactttcagttcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtgcttccgcctgatttttggggctgcgggggcgggaccggggtgtgaccgcctcggggtgggccgcgagcaaggcaggcgactccactgggcgccatcttcggggaacgactcagcgcaggattgtaaatacaccgctggggtggggcggggaggacggtggcctgcaggacgcaaaaagcggaagccgaagcatgaggcctgcgaccgttaggcgggcgcgcgctcagggattagccccgccccgtccgtgcccccggcgcgcgcgctcccccattctcccgctcggcaacgacggcggccttgtgcgcgtgcgcgcgaaataacggccgctggcggagggagggggagtggaatcgttggcggggggaagaggagagaagccgccctgtctcccgcgcgcccaccacctgcgccatcgtcagccaatcagcagccgtctcaggggtctcgcgctcggggcgactcgggctgctgggtggctcccccgtccctcctcccgccagagtccctctcgcgcctgcccctcccgctggccacgcgcgcgctcgcgctagcgctcgcgcccgctccagcctcttgtgtgtcctcgcgccccccgcccgccctccccgcgcgtagtgtgctccgcttcccccaccctccacctcccccctcctgcccgccccgcgcgcctcctcccgggttccccctcccccaccgccgccgcctcctcctcccgccccagggtgagcgcgagccacctccctccctccctccgccatggatcccagcaactggagcagcttcatcttccaggtaacaactccctccccccgcccccacccccctgcccacaccccctcctgcccgccctccctcccgtcccaccccccctccgcgcgcccggtgcgcgcgcagctgtccccctccctccctcgcgccctcccccgccctccccgaggcgccggctgggcgcgcgcgcggcgggggccgaggctgctccctcgctccccccaccccgccccgccaggctccaaccgccgccgccgccgccgccgccgcccgggcccccgcccccggccccggccccgcggggcctcccgcccccacccagggggcgtcgccgccgccgtcgccgcggcgctccgcggcccgcaaggcgccctcttttcctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggtgagtagggccggccgcggcggcccgggctggggggggacgcccgcccgcacccgcggcccactcggcgccttgtctccgcaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccaggggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgaggtaggaagcccgcctcctcctgtcttggttttcatgattttgatcctcatggtagctgtctgagtcagtctctcagaccccctttttctctctcttctttttgcctttttgctccattttctcatcccttcttcaaggcctcatcatgtcactcccatttcctacagatcaaagatccccaaggctctgattcctttaatctcttgctcccccctccccagcccaccaagctttaactctcctgtgacaccccccacgcccctcccccctcctcagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaagcgggagtggaacttggctgctctggggaaggagtagtcaagaaagccagttccaggggtcacaaggcaaggtttccgctgcgcagccacaaggtcttgtctccagctcctggggcaggtggagtacacgggccgggctttaccagcacgcaccctgcacgggtagcagagaaagctgccttcagtcagactcaccggttaactgggttgagaccgcggggcactggagggaaggggacacagccgtctctgctgagggtcaaccctgcaagtggctaggagtcagtgtctcgtcatcctgggagaggtctcccggccatggagaatgagttctgtaggtaccaaggctgagaagcgggcaccacacaagccaggccccaggctcagggaggggctgtgtctaccagccccaacagagcagttggccccaggctaccaaggataccgtgggaggaggacagggccatctgaggagggcatcccccgcctaggagatcagccccgtctctggggtctccgcctggctgacccccgccccatcccaatccaccccccaataggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccgccccccctgtcccgggagacgccccccagccacagcccacctgctgagggggacccccgcacccaccaggcaaggcgtggggcatggctggggggcgggatggggggtgtgggggacaacggggctcaaagggcccaataggggatctcaggaaggcgagggatgcccatgtaccactcaggctagggagacttctgggcacagggaggatccttgagaactgctctgtctgggtgaggatgcaggctgaggcctctggggtccagataggaagtgagcaacggctgtgtcccaggggaagcaggctgggaaggtgtggggtgagggcaaggctcttgccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattgaatgaattgccctcactaagaactgccgccaaccccaagggtttcttctcggcctggtgtccgtcaatccagccttgctctgccctgtgaggctgtgaggttctggctccgccctccccaggggcagccttactggcggcagcacagatacagggcggggccaaggctgtggctgtggagagcaagttccaggtctctggggaattcccaactcggacaggcccagaatagcccctggaggtttgaagaggccccgtcagaaacccaaacagagctgccagacgggaatgccgccctcccccgtccacactcatggccgctgctcagcccccagccgcatccctccccacgcgcgtcacggccctgaggccatggtgggtggatgcggctgcggaaaggctggggagtccgagccctaggactgggagcagcgaggtagagaatgaaagctgcacctgtccctcatcctgggcatgggccactctgtgtttacacgggctcctctgcccagctcctcctgccccttggaattccctttcctgtccccgctccgtcctttccagggccccttttttgagccttccagcgccagtttctgccgctcctttctgcaggctccattctctccaaaccccaccctgctcctcctctgcagcctccccgcgtcttgccccatcttccttgccctcctgctcgtagagacgcctccacccggtcctgcctgtctcactggtcccgtctcctcgcagaaccctctccgtttcccccaaatccccgtctcttccaggaatcccggtgaccgttggcgggaggggccggggacttaagaaggaggcgtctctcctggaggcgcgcgtgagaaggggcagggagggggcgcgagtggtccccgggccggttgcctgggtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgaggtgagacccgggcagactgaggctgcgggtaggagtggaccgaccgacggctgacgccgggcggactgcacgggaatgcgggtgtctggagggctggtggtggtgctgggcgggctgaaccatcgggaggaggcgccagcccaccgaaggcgagggaagccccgggagaggggctgacaggggatcgaaggagataaccaggtcccccagaaaggggcgggagcgtcctcgccctaaacgcgcagcaagaaaacccgcaccgcctgggagcccagggaggaggggaggatgcagagggagtggaatgcgaatgtcgggtcctctgcccagtcggcctgtcggagtgctatttgcacagctcgttgattttggggtgctgggatctgagagtctggatcttgttggatggacccagggagagaccctggagaaggtcctgtttacaaaagggttaatcttccccagggctctccaagcagaagactttgagtagagcactcctcccgcagggatgtcccaccctaaggcaaaggaaaccccaacttttcttcctctccctagaggcagtgcaaggctggccctgagacaggaatgtggcccaattgggcctgcagtgctgagcgccctcttccctcctcaccccaagcctatctcctcctcttccagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggagtaatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgagactcgcctccaatctcggttggttcctgcgttcgtcccgccggcccggcggtgctgcctttctggcagaaccttactgggtggtatacgcatgcgacttcccggtggccatctttactgtgggctgaagcctgtgcgcttactcgcgcatgtgcaagccttccctcgctttcctcttccaagtagccttgcctagagcggagcctcccgcgccatttctgtgcgcctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgccggcctcccacgccggaggcccagagcgaagaggagagatccgatgaggagccggaggccaaagaagaggaagaggaaaagtaaaggcacacccttacaccttgtcccggggctgctcccctgatggcgggaggaaatagggaggggaaaatgtgggacgctggaacctttgaaagtggagggagggaagccagcgggggaggaggaacgggcaggggagaagcacacgtgtgggtgggagggaggaccgccctcacccttaactatgttcacctgtcccagaccacacatgcccacggaatttgattttgatgatgagccagtgacaccaaaggactccctgattgaccggagacgcaccccaggtacaaacgaagaggaaacagttgggggaggtgaagggcctcggctcagttacccaagatcggctcccctagaggcctttgcttgctgcctcagctcccacacaacttacagctgcaggagagagtattcacccagtagcaccatctttatgacttagattactaccttgtcttccttttttttttttttttttttttgagatggagtcttgcccttgtcccccaggctggagtgcaatggcacgatctcaactcactgcaacctccgcctcctgggttcaagcaattctcctgcctcagcctcccaagtagctgggattacagacgcatgccaccactctgggccaatttttgtatttttagtagagacaggctttcaccatgttggccaggctggtcttgaattcctgaccttgtgatccgcccacctcagcctcccaaagtgctaggattgcaggcatgagccaatgcgcctggccccttgtcttcctttaagagacaattataatacaaaaaattagccgggcatagtggcgggcacctgtagtcccagctactcaggaggctgaggcaggagaatcgcttgagcctgggaggtggaggttgcagtgacctgagatcacaccactgcactccagcctgggcgagagagtgagactccgtctcaaaaaacacaattacagataattctttttttaaaaaaacaactagtcattgattctggaaaattacagataattctatcatgtttcccattcccagaagtccaagtcctggcctttcaatattatctagatctgcatccctctactaccatgtacattctttaatcacaccgctggccccatttcccaccccacatgccttcctagaatttaccctcagagtcatgcctttccttttttcttttttttgaggggtggagagacagagtcttgctgtgttgcccagactggttggtctcgaactcttgagctcaagtgatccatccgcctcggttctcaaagtgctgagattacaggcatgagtcactgcacccagcctagagccattcttgatttctctctcttttacctgaacattcacaccagcagcaagtcttggtagctataagatgtacatttccaagtacctctgctagtctccactttcaataccacatccccatccaagccactgtctttcttgcctggatagttgtagtagctcctaactgggctctctgcttccagcttctgcaattcagatgaaccttttaaaacataaatcatatcactttttttttctttgagacgaagtctttctcttgctcaggctggagtgcagtggcatgatcttggctcactgcaatctccacctcctgggttgaagcgattctcctacctcagtctcctgagtagctgggattacaaggacacgtcaccacgcctagctaatttttgtattttctagtagagagggggtttcgccatgttggcgaggctggtcttgaactcctgacctaaagcttcccaaagtgcctgcctcagcttcccaaagtgctggaattacaggcgtgagctgctgcactcagccataaatcgtgtcacttttccacttaaaattttccaagggattccatcttgccagggaagagcatgtcaaaggagaatccaagcgcttttcccgccacctccagttctctgcactcttttttttgtttttgtttttggcgagtaggggagacggagtgtagctgtgtcaccgaggctggagtgcagtagtgcgatcttggctcattgcaacctccacctcccgggttcaagcgattcttctgcctcagcctcccaagtagctgggattacaggcgcccaccaccacgcccagctaattttttgtgttggccaggctggtctcaaactcctgacctcgtgagttgcccacctcagcctcccaaagtgctggcattacaagcgtgaaccaccatgcccggcctgcactcttctttgaacagaactctgttcttgtcctggggcctctacccttgccattcccctgcccagtatgttcctccctgttcttcacattacctgtgccttcctgtcaatcaagatctttgcttctcaccctctctgaggtccaaccctgaacctcaggtcctccaagacagaggcctggggacctgcatgtttaaccagctccccaagtgatgagtgaggtccaggcaggtatggtgtacaccacctccatcccttccatgtatcttaccttcctcttctccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagctgcagcagaagcagcccggaggataaaatgagaaccagctgcacacgggccctttaactcccaagccccacccctgggcttggcctgccttgccctgccgggaagtgatccccaaggcagggtgagagttccccatctgaggcgtttgttgcagctacctgcacttctagatgtgagtacattgtactagccccccaaaccccaaatcaggggcagatctttgtatcccttgaggctctctttagtcctgtcttgctttgaagggccttgcttctgctggggcagggaaaacatgtctgaatcagagtggggaaggaggatgggtggtggctttgcttttggaggtttcactttccaatagttgggagtcttctgggttttgaagtaaaggcagattaacaccaacaccggtcccccacccccctgcaactctcaggcctctctctgacttcagggtcccacctgggaaatcaggtggggaaccttacagggtcattcagaccccatcttagccctagatcggtgcttgctctactcacctgcactgtcctggggacctgggctctggcctgtcaccttgagctccaagaatgtgacctgtacccattcaggccccttaactctgacagatgagggtttcttactcctccatgcagggctgggccagctgttggtctcagtcgatcattcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagcacttgggggtggaggtgatagcgaggctgatggcccctgtgttctcagctctctgcctgggtagcccctgggtgatgggggagaggccagctgtcacgtggggtatcaggtggctctgccagaaactcccttggcacacagagcactgggtcggccctcgggtgtggctgtttgggcaggacagccctctgtatgtagccttgagcaggtaggggggccaccttgagtgggtggcccagagacagcctcagggctccaaggtaacggggtgctcaggttatcttgggtgctgccctcccaggttctgggggagcagaggctgggcgctggcccaacttacaggaaacactcacctttgaactgccattagcaccatctgggcagtacacagccccacccaggtcctctagttcttgttctcggcttagaatctttgtgtttctgcctgagaagccactgcctcctagtttgtggtctctacagttatagccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttacttaggggcgtttgcctagaacacagggtccagaggctctctcccggaaacttagacccagtgagtcagaagtgaggcctgcaaaaagcagcaggagtggggttaagaattccagcctagggctggatgcggtggctcaggcctgtaatcccagtactttgggaggcccgaatgggaggatggcttgaggccaggagttccagaccagcctgagcaacatagcgagaccctgtctctgtttgtgtgtgtgtggttggggttttgttttttttttttttttaaagaattatagctcagtcctatgattaggcaagttgagaaaatattgatgaagatcaggggtgctgaagcctggttcctggggtcgcttctgatctaggcggttcttgcctctggtgactggtgttaattggcaggagtgggaggagggaggacaagtggaagtctaggctggctgagctgttctgtctcgaaaagttcctaaaactgtgctgctttaaaaaaaaaaaaagtaatttatgagacacattctcaatttccattaatcatctcctaaagggggtaaaccaggaagccgctgggtgaaaacaggctgttggcaattcctgagtcatgtgacccattctctaaagactagaatatttaacttaaatcagtgagaaactctgtgaagttgtgtccttgtttataccaaacttcatgtgccttttcctgaacctgaagctgtgggaaggtctgggggcagggccgcatcaccgaccttacgtccaacctcaggactgcctggagcaagagccctggggttggggacaaaggaggctgcctggacctgggtaagggaaggggctggaggagaatgagtgcaattccctgcccttcacagcctgcaatcggagctgtgtttttgtttttgagacagagtctcgctctgtcccccaggccagagtacaatggcgcaatctcgactcactgcaacctctgcatccctggttcaagcaattctcctgcctcagcctcccgagtagctgagactacagttgcctgccaccatgtacggctaatttttgtatttttagtagagacgaagtttcaccatgttggccaggctggtctcgaactcctgagctcaggcaatccgcctgccttggcctcccaaagtgctgggattacagccactgcgcccggcctgaaactgatctttatcctcctcccagttcctactgtgcaccagagaccctccagtctctaatacctttgacttgaagagcagtcatttttttttccttttcttttcttttcttttttttttttttttttttgagatggcctcactcttgcccaggctagagcgcactcgtgtgctccatttacggctcactgcagccttgacctcccaggcacaggcgatcctcccacctcagcctccaaagtagcagggaccacaggtgtgcaccaccacacctagctaatattttttatggtttttatagagacagggtctccctatgttgcccaggctggtcttgaactcctggcctcaagtgatcctcccatcttggtctcccaaagtgctgggattacaggtgggagccaccaagcctagtcaacagtcacttttattctcacttcactggagaggaaggctcagaggctagtaagtggcccaggagcatgctggcagtgataaaacctgctggagtgacattttcccactggctctcaatcctggatatatattaagagtcagaggccaggcgcggtggctcacgcctgtaatcccagcactttgggaggccaaggcaggcggatcacgaggttaggagatcaagaccatcctggctaacacagtgaaaccccatctctactaaaaatacaaaaaaaattagctaggcgtggtggtgggtgcctgtaatcccagctgaggcaggagaatggcatgaacccgggaggcggagctgcagtgatccgagatcgtgccactgcactccagcctgggtgacagagcgagactcgtctcagaaaaaaaaaaaaaaaatgagggagaactttttacaatagcaacgggtgaacctcacccagaccaattaaatagaatcaccggagatgggtggctttaaaaaaaggtctccagaaggcctggcgcggcagatcacacctgttatcctagccctttgggaggccgaggtgggtggatcacttccagcctgaccaacatggcgaaaccctgtccactaaaaacaaaattatctgggtgtggtggcggacatctgtaatcccagctacttgggaggctgaagcaggagaattgcttgaactcgggaggcagaggttgcagtgagccgagatggctacactccagtctgggcaacaagcacgaaactccatctcaaaaaaaaaaaaaaaaaaaaaaaaaaaaaacagatttccagatgaccagtgtgcagcccgagccgagagtctgctttagaccagagctgctcagactgtaatgtgcatgcaagtcattgagggtcgagttaaaatgccagtagattcagtggctctggggtggggccccaggctgtgttgctatcaagcctccaggtggtaccactctactcactgcagaccccgtaggcagtgtggtcacttggtcaattgccatttaagactcactaggggccaggtgtggtggttcacgcctgtaatcctagcactttgggaggctgaggcaggcagattgcctgagctcaggagtttgagaccaccctggggtgaaaccccatctctactaaaatacaaaaaattagccaggcttggtggcatgtgcctgtaattccagctactcgggaggctgaggcacgagaattgcttgaacctgggaggtaggtggacgttgcagtgagccgagattgtgccacttcactccagcctgggctacagtctccaaaaaaaacaaaaaagagattcagtatatcagctactcacagttgaccctgaagatctctgggaagtagtgactcatgactcgtttatttattaagttttgctgtagcagaagtttacttttgagccaagagtctgatccggtctccctcttttttttttttttctttctttaaagagatggggccttgctatgttgcccaagctggtcttgaactcctggcctcaatccatcctcccaccttcggcctcccaaagtgttgggattacaggtgtgagccacctctctcaggcaagagcccctcttttaactagacaatgaacctggtttctgctttggacaggctatttagttcctgcttatttaccctcatggtgggagagaccctggtgggatttggggtgaaagctggctgtggttcttgcaggagcctcatgacacctgagggaggtgtgatcaggcaagactgggcctctacactgagagccgactagggcaggtctcagaagcagagactgaaggaagttgggtggatgagtggatctggggagcaggggccaagcctgagggctgggcagagccttccaaaggtcaacacaatccttgctattgtcttttgagggccctgatctattttaagtaaaatgctctaactgcgcatgtcatctggaaggaaaccacaaaaaactcaatctgagacttgtcaccaatgtgctgcctgagtcaaagggtttccctggctcacctccatagatggcgagggtagaaggcaagacctgtcctgggtggtctaggcagaaggcccaggtttagggcatggcaggtgggtggtcagggaggtgaggtggggtcctggtgctgatgcaggggcagttgccgagggcttggcctcagaacaaggcaggagtccagccatgaggatgactcttgctgagtcactgagctgggcgaggcattcagaccccctgactgggcccagctggggcggcagatggtggagaggcctcagctgtggggggtgttggggagattatccactgatgaaccaaatggaggctgttcccagagcctgcttccaaccttgcacggccttctagagttcaaatctttcctgggggggcctcagagccctgtccatacctccgctcacagccccagcccttcctcttctcccatctggtttcctggccaggtttcggccctgcggagaaccctccaagggagcagtggaaaaagcttcacttggcagtaaagcccctacttgctgttccatccctgcagctggggtgaaataagccactgaccagtaaacaactgaggcttaaaccagcatgccagctcaggtggggagcccccagcactggttatattccctagattcctcactggataggaaagttgggcctcaggcactcttccctcctctgcagtcaaacagtgcagatgaagagccaggctctgttcccagtgctttatgtgctaacttggttgataatgttatccattctcattttgtagatgaggaaacaggcacagggtggtcaagggacttgttcaaatcactgatcccataagggtgagagccaagatccaggcatcctggctgggtgcggtggctccacctgtagtcccagtgctttgggaagctaaggctggatgactacttaagaccaggattttgagaccagcctggacaacaaagaccttatgcctacaaaaaattaaaaattagctaggtgtggcagtacgtatctacagtcccagctactcgggaggctgagatgggaggatcccttgagctgaggagttcaaggctacagtgagctgtgatcactgcactccagcctgggcaacaaagtaagaccttatctcaaaaaaaaaaaaaaaaaaaggccgggcgtggtggctcacgcctgtaatcctagcactttgggaggccgaggcgggtggatcacaaggtcaagagatcaagaccatcctggtcaacatggtgaaaccccgtctctactaaaaaaaaaatacaaaaagttagctgggcatggtggcaggcgcttgtagtcccagctacttgggaggctgaggcaggagaatcatttgaactggggaggcggaggttgcggtgagccgagattgcgccactgcactccagcctggcgacagagtgagagtccatctcaaaaaaaaaaaaaaaaaaatccagatctaggcattcccagccctctggactctaggaagtcgtctttccagaacagagccccgtattgtggagcaactggggggtggaatcaaaggtgagcaggacagggctataggaagaaaagacaaggtccccataagagtggcgagaggaacagagccaggacatcggaaagcaagcccctgtgttcccaaaccgcagaagagggagctctgatgttagacaagccaccctcctacaagcgaagggaaagtaactttgagcaaaaatgagcaacagaaaatgagatcaaggtcagatctcatacaaagttgcaagatgaaagaatgagcagcagaataacctccctgtgatgtggaaagtgtgccaggaaaacagacccaaactgtaacctctttcagaatgaggcaaggcagtgaggaaactatgtgaaaacacgaaagcagccgatcagagttgtaagcccgggcagtctgggttggaatgggtgccccgagccacgggaccatgatgcctctctagaaagacaggaccaggcattccaccagggttctagtcccaacagcaccactaacttgcttgtggccctaaaggattcattgtccctctctgggtctcaactatttagagctctactgtccagtatgggatcaaccagccatatttggcaatttaaattaaaattagctgggtacggtagcgtacccctgtaatctcagcactttaggaggctgaagcgggaggattgcttgagcccaggagttcgagaccagcctaggcaacatagcaggaccttgtctctgcaaaaaaaatgaaaaaattagctaggcgtggtggcacatgcctgtaatcccagctactcgggaggctgaggtgggaggatcacttgagcctggaggttgaggctgcagtgagtcatgattgtgccactgcattcctgcctgggcaacagaacaagaccttgtctcaaaaaataatttaaaaatttagttcctcagatgcattagccacattttattttatttttttccaagacagagtcttgctctgtcgcccagggctgtagtgcaatggcgagatcttggctcactgcaacctctgcctcccaggttcaggcaattctcctgcctcagcctcccaaatagctgggattacaggcacgtgccaccatgcccagctaatttttgtatttttagtagagacagggtttctgcatgttggccaggctggtctcaaactcctgaccttgtgatctgccgacctcagcctcccaaagtgctgagattacaggtgtgagccagcatgaccggccattagccacattttaagtgttcaggagccacatgtggatgtggctagtccaaagacagcacagatttagaatattctcatcattgtagaaagctctattggacgctgctgagtaaaagggtttttttggtttggttttgagattggagtctcgctctgttgcccaggctggagtgcaatggcacgatctctgctcactgcaacctctgcctcccaggttcgagcaatcctcctgtctcagcccccctagtagctgggattataggtacccgccaccacaactggctaatttttgtatttttagtagagacggggtttcgccatgttggccaggctggtctcgaactcctgacctcaggtgatccacctgccttggcctcccaaagtgctgggattacaggcttgagccaccacgcccggccaagttaaagggtttttaaacaagagctgggcagtgcaatggcatagctgtaaggcagcagggggtggtggggactgtggtaggtgggaaagcttgtgttccatctaaatggggcagctgctgcttgactgtaggctgtattgctggtcttctaattcttcaagtgaatcaggaattgggattttgtgaagactcacaatttctaaacaaaaagttgaagttttacagatcgtggggctcaagtataactcctcttgggctgtatccagccttgattctgtaatctgtggctcctgcctgtttttcctcggccaggccactcccttcttcccctcacttatatttttcacctggggttggaggctgggtagatggtggaattgatgaggaaccacttttttttttttttttttgagatggagtctcactctgcctctcataatgctgggattacaggcatgagccactgcacctgtcctggccagacatttttgaggccaccaccagacaaaagaggctcctcatcggccaggtgtgatggctcgcctataatcccagcactttgggaggcagaggcaagaggattgcttgaggccaggaattcgagaccagcctaggcaacataatgagacctcatctctccaaaaaaaaaaattagctagacatggtggcatgtacctgtagtctcagctacccaggaggctgaggcatggcttttgtgagctatgattgcaccactgcactccagcctgggtgacagagtaagactccgtctcaaaaaaaaaaaaaaaaaaaaaaaagtctgacctgagtctcttaaggatgaggctctggagcacctagtaaacttggtcccatttgtgtgactcaaagggacatgtccaaagtccaaagtgctgggggcaggggtggggcttaggtagggcatgtgacattcctgaacaggccaagcactgggtgaaactactcaggattcagaagcaggtgggatgggtgggtggaacatgataatcatcccccttctccttcctttccaccctacccttgctcacaactgcaggagctgaggatgggagagaactggggacgagggggccagagtgatttgcagtgttagtaatgcagctggttctatggaaggctcagttccatctgggatccctttatgagcagtggactaggtcttcacattcagcccaggattactaaagcataggaaagaggcagggaacatagacacagctcatgtaaacattccttttgtttatggccgaatcctagccactggactacctgaggcatacagatattctttggctatgggctgacatttgaatacagctggggcctcaggattctctgaaataaagggctgcctccctctggaggagccaggcagctcctcagagcagctgcccattgcgtgctggacaaggccatgtcaccacctccatggctccccagtttcccagcttgctgtatctctccaccgtaagagactgggagcaccttgatctgaagctctttgcagtgccggtggcagtgtagggggaagtagttgatgggagtgagggaaaggaattggcaaggaaccctgggcctctgtggctcactgcatcaagcagttcttggcaaaggtaaggtcaggatgggctgtgtcgtcttgggtggggtgaagacagggagcagtgggcatgcagatgcggacagggaagggtgcagtggcctggctggaggaggtagggccgtatcccacccagagtctgtcaccagattcatgcctgccccaccccaggctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggtgggtgtgggggctgggctgtgggggatccttggggatgtgggggcctgtttggctggcatgatggtccttatcctcctccctcttcccaagcaggagtggccctcgcttgggcgatagagaggtttctctctcatttggtgtcctctttggtagtggagacctggtcccaggtcctcacacctcttctcatcttcctgcagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggtacctggtttcctcactccctatgccccaccctacctgtcctccacctgccttgggctctatactgctgccttcttcttctttttttcttttcttttttgaggcagagtttcactcttgtcgcccaggctggagtgcagtggcataatctcggctcactggaagctccacctgggttcaagtgattttcctgcctcagcttcctcagtagctgggattacaggcacccgccaccacgcccggctaatttttgtatttttagtagagacagggtttcaccatgttggccagtctgatctcaaactcccgaccccaggtgatccacctgcctcggcctcccaaagtgctgggattacaggcatgagccactgttcccggcctgtaccgagttctaaagggaaaacaaaccagggcagtgggaggggtggggagagacacttgctggctctcaccaagggtggaattgactcactgtacctccactcacctccagccacccccatcctccacacatgccccaaacacacctgcctcttttctgagaactgttggcccatctcaccttcccaggctccagagcctaccagaagtgcccagccagtctggcattaaatgacatgtgccaaggttaagcagttcattcacccggtgccagacactggtgggcagtgccaaagcagcagtgacaagcccaggccccaggctgtgcctgttctaggagaagccatcacaggcctgaacctacagccaggctcttgtccccgttggcctcaggcctgggcctgagcaggtgggtgtcccaccttcattcctttacctgttcttccacctttaccttctggccatttaatggttttgggttttttgtttgtttgtttgtttgtttttaatagagacggggtttcaccgtgttagccaggatggtcttgatctcctgacctcatgatccgcccgcctcggcctcccaaagtgctgggattacaggcatgagccaccgtgtccagccccatttaatggttttcttactgactttactaaccagtgctgcttgatcctgaaagcataatagcagaacatggggaacttttagagacattcatgtccacttaggtgcagacagtttgggggaagaagtgtgtgtgtagagagaaaatgaagaatgattaagacaataacccttaaggaatccaagtgaaaagtatatagggattcttgtacctttttttttttttttttttttttgagatggagtctcactctgttgcccaggctggagtacagtggcataatctcggctaactggaagctctgcctcccaggttcacgcaattctcctgcctcagcctcccgagtagctgggactacaggcgcccaccaccacacccggctaactttttgtgtttttagtagagatggggtttcaccgtgttagccagggtggtctcgatctcctgacgtcatgatccacctgccttggcctcccaaagtgctgggattacaggcgtgagccaccgcgcctggcctttttttttttttttttttctggatctccccctgttgcctagacgagagtgcagtggggtgatcatagctcactgcagcctcaacctcctgggctcaaacgatccttccacctcattctcccaaaatgctgggattgcaggtgtgagccaccaagccctgcctaagctttcattttaaatatgttcagccgggcacagtggctcacgcctgtaatcccagcactttgggaggccaaggtaggcagatcacttgaggtcaggagtttgagaccaggctggccaacatggcgaaaacccatctctactaaacatacaacaattagccaggcgtggtggcatgcgcctgtaatcccagctacttgggaggctgaggcatgagaattacttgaacctgggaggcggagattgcagtgagctgagattgcgccactgcgctccagcctgggtgacagagcaagactctgtctcaaaaaaaaaaaaaaaaattagctgggggtggtgacacacctgtaatcccagccactcaggaggctgagacagaaggatcacatgagcctgggagattgagactgttgtgagccatggttgtaccactgcagtccagcctggatgacataggaagaccccatctccaaaaataaaaaaaagccagctcttcctttgagccccagtttcagttcaaagggccttctctaacttctccttcatctgaactcctgagacagggtcttgctctgctgcccaggctgaagtgcagtggtgcagtcatagctcactgaagccttaacctcctgggctcaagtgatcctcccacctcagcctcccgagtagctgggactacaggtgtgcgccgccaccatgcctggctacactttttttttttttttttttttttagagatgggatcttgctatgttgcccaggctggttcttgaatgtctgaggtcaagcaatcctcctacctcagtctcccaaagttctgggatgacaggtgtgagccactgtgcccggcctccaccccagtcttatttcaggacatacagagatggatgttgtggacccgcctccagagcatcaggcttggccctggggtcacagcactgatggttctgtgtctccaccttcttccccactaggacatcacacccctgcaggtggttctgcccaacactgccctccatctaaaggcgctgcttgattttgaggataaagatggagacaaggtggtggcaggagatgagtggcttttcgagggacctggtaagttctgtctccatagggctccctgccttcctgtcatagccctgataccttctgaccatcaccttccctccccaggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaaggttgaggaaagcctcctgtagccccagagaggcgctttcctggtatcttttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagatgttcaaatacaattgacaaatgtaggccaataggtacagtggctcacacctgtcatcccagcactttgccaaggtgggtgaatcgtctgagcccaggagcttaagaccagcctgagcaacacagtgagaccccatctctacagagaatttaaaaattagcctggccttggacacacacctgtggtcccagctactcagaaggctgaagggggagaatttcttgagcccaggatgtggaggctgcagtgagctgtgactgcaccactgcactccatcctgggccacagaggtactaccccgaggtgctaccattcccactttttttttttttttgagacggagtcttgctttcttgctgttgcccaggttggagtgcagtggcgcgatctcggctcactgcaagctccgcctcctgggttcacaccattctcctgcctcagcctcctgagtagctgggactacaggcgcccaccaccatgcccagctaattttttttttttttgtattttttttttttttttttttagtagagacagggtttcaccatgttagccagggtggtcttgatctcctgacctcgtgatccaccaggttcggcctcccaaagtgctgggattacaggcgtgaaccaccgcacccggccattcccactttctatatatcaaaactgggatgcagaatgcaggttgcttgccctggggtgtggccaggcagggcgaggctgggacctgcatccaggcactctggcttctccagtaaaccaaaggacatccacaactctaacagaggcagttctgctgcctgttttagcagaaggacaaaagttggtctttggagcttagagaaggcagaacaggctgttggcatagcagcaacttgggcatcttaggaggccaaggtgggcggatcacttgaggccaggagttccagactagcttgggcaacatggtgaaacaccatctctacaaaaaatacaaatattagccgggcgtggtggcacgtgcctgtaatcccagctactcaggaggctgaggcatgagaatcacttgaatccaggaggctgaggttgcagtgagctgagatcacagcctgggcaacagagggagactccgtctcaaaaaaaaaaaaaaaaaaaaaaaaacttttaaaattcaactggggtgggggtttggcctcaaaagaatgaataagaggaccgcagtcaggaacttgagcctggggtcagtgctatctttttgcctatgaaatctgtcaatcccctgtgtctaagctgtgggggaggggtaggtggggagcaggctggggggcccttgtcccttaccctccactcttggcccaggggaagaatggctggtcaccacagtaggggcgtacctcccagcggtgtttgaggaggttctggatttggtggacgccgtcatccttacggaaaaggttggtgctctgggggctgtggtttaagggacctggggctagggaaccctccgagtggcagagaatggtggtagaatggcatgagagtaaaagagaagcaataattttagggtcacttaaaaaaattcagagatcagattgcctgagtattctggatcatctgaagggttaaatagtctttctggggctgggcgcaatgactcacatctgtaatctcagcaatttggaaggctgaggcaggaggatcacttgaggccaggagtctgagaccagcctgggcaacacagtgagaactcatcgctacaaaaaatttaaaaattagctgggtgtagtggagcatgcctgtaattccagttactccagaggcgctgaggcaggagaatcgcttgaaccccagaggcagaggttacagtgagccatgatcatgccactgtgctccagcctgggcaacagagcgaaaccctgtctcaaaaaaaaaaaaaaaaaacaaagccggtcgggtgcagtggctcatgcctgtaatcctagcattttgggaggctgaggtgggaggatcacctgaggtcaggagttcaagacaaacctggccaacatggcgaaaccccatctctactaaaaatacaaaaattagctgggcatggtgtcacccacctgtaatcccagctgtactcaggaggctgaggcaggagaatcgcttgaacctaggaggcggaagttgcagtgagctgagatcgcacctttgcactctagcctgggcaacaagagagagactccgatttaaaaaaaaaaaaaaacaatccctggattggtagaaattgtctctgagatctgggagcattgggagcatttggtggccaatggggctcgcagatcccctgaagttggaggcaggtcactcaaatacccaacatgttgctctgcagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaaggtgaggtccctacacccccacagaggactgccctgggagatgtatgtcctctagtggcatgaggccctctgccttctctcctccagacgcacgttctaggaacaccttctgtgcctttgcatgcttagttcttacacacctgagacactggcccatttgattcctggcagcctctgacttacccctcagacctgaagttaattccccttctgggaaggcctcctggctacccgctgcctgagactctgaaactctgatacagtcatgcgccacttaatgatggggatacattctgagaaatagtccttagatgattttgtctttgtgcaaaagagtgcacttatgcaaacctagatggcacctagtctagatggcgtagcctgcccctaggctgccaacctgtgcagcatgtgactgtcctgaatactgcaggcagctgaacacaatggcaagtacttgtgtatctagccatagaaaaggtaaggtaaaaatacaatataaaagcttcgttataggccagcacagtggctcatacgtgtaatcccagcactttgggaggccgaggcaggtggatcacttgaggtcaggagttcgagactagcctggccaacgtggggaaaccctgtctctactaaaaatacaaaaattagccaggtgtggtggcacacacctgtaattccagttactcgggaggctgaggcacgagaatcacttgaaccctggagatcaagcctgtggtgagccgagatcgtgccactgcactctagcctgggcgatagagtgagactctcagaaaaaaaaaaaatctccattataatcttacgggaccaccatgtgcagtctgtaatggactgaactatcatgcagtgactatatttcacatctttaatatcctggtgttcactttgctttgtcatcttttgtaaaataaacctcttggtttaccctctcccaccccctacttcatcccctctctgaactatatgtgggaataccagcagttgccaaactcattctgtaaagggggctggatggtagatactccaggctccgtgagtcattgtttctgtggaagttcttcaactctgctgttatgtcaggaaagcagcttgggcactacgtaaacaagtgagtactgccatgctcctggaatagtttatctgcaaaaacaggaggcagaaaaagtagaaataggccaggcatggtggcttacatgtgtaatcccagcactttacgagtccaaagcgggtggatcgcttgaggtcaggagttagaaaccatcctggccaacatggcaaaaccctttctctactaaaaatacaaaaaaattagctgggcatggtgtcaggcacctgtaatcccagcttctctggaggctgaggcaggagaattgcttgaacccgggaggcggaggttgcagtgagccgagatcacaccactgcactccagcctgggtgacagagcaagactgtctcaaaaaaaaaaaaaaattagaaataacccaaatgtacatatataatgaatggataaaaaattgtagcatatccatacaatggaatatcattcagccataagaaagaaatggcaggccaggcgcaacagctcatgactataatcccagtgctttgggaggccgaggcaggaggattgcttgaagccaggagtttgagaccagcctgggtaacatagtgagaccccatttttacaaaaacttttaaaaattgaccaggcatggtggcacacctgtagtcccagctatttgggaggctaaagtgggaaaatcgcttgaccccaggaagtggagtgtatagtgagctatgattgtgccactgtactccagcctgaggcagtagagtgagatcctgtctctaggaaaaacaaaaaataatgacatacgtgctacaacatggataaaattgaaaatgttatgctaagtgaaagaagccagctggacgcagtggctcacgcctgtaatcctaacactttaggaggctgaggtgggcacatcacctgaggtcaggagttcaagaccagcctggccaacatggtgaagccccgtctctgttaaaatacaaaaattagctagcatgatggcgggtgcctgtaatcccagctactgctcgggaggctgagacaggagaatctcttgaacctggaagacagtagttgcagtgagccgagatcccaccactgcactccagcctgggctgctgagccgagactccatctcaaaaaaagaaaaagaaaaaagccagacatcaaagaccacatattgcatgattccatttatgtgaaatgtccagaataggtaaacacataaagaaaatagactagtggtgggtggggtaggtggggagtggcagtaacttctaggtacaggatttcttttcagggtgatgacgaaaatactctagacttaacatagcagtgatggttggacaactttgagtatactaaaacaactgaattgtgaattgtatactctagatgggaaaatttcatatgtggattatatctcaaaatttttttaagaaacaggcggtgctgggcgtggtggctcacatctataatcccagcactttggaaagctgaggtgggtagatcgcttgagtctaggactttgagaccagcttaggcagcatggcaacaccccatcatctacgaagcacacaaaaattagctgggtgtggtgatgcgcatctgtagtcccagctccttgggaggctgaggtgggaggattgcttgagcctggaaggttgaggctgcagagagctgagatcatgccactgcactatccagcctgggcaagagaggaagactatctcaaaaaaaaaaaaaaaaaaaaaaaaaggcagaatccagatttggcctgaaaaccagagtttgtcaagccctaggttacaccatctctagaaaacaaagcctgggagaaagaagaaaaaacaggttgatttttaatggtttagcttgcgtggatccaggtcctgacagttatggaatctttcaaggacacatttgaccagatgagatttggcaggcgtttgtgtagagcctcacagtccagacagtgcctcaccgtattatgatgtgggggtgggggcgggcttctggtgctcttgtcctccacacaggcctgaaacagcacaggactggggaggtaccattggaagcacccgcaaccctaaaggcactgaccctaacctcacgtctccccactagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtaatggctgggagtgagcagcagtgctgccacgtggccttggccttggtggcggcttcctctgggtgtgtggaagaggtgggcagggacttcagcagcatggagagccatatcaggtgggctgtctggttgggggagggcactacgtggagtgtttgccatccttctgccttaaatgtctcatttgaaatgttagaaccaaccaggtgcggtagctcacatctgtaatctcagcactttgggaggccgaggcgggcggatcacctgaggtcaggagttcaagactagcctggccaacatgggaaaccctgtctctactaaaagtacaaacattagtcaggcgtggtggtggtctgagtagtcccagatacttgggaggctgagacaggagaattgcttgaactgggaagcggaggttgcagtgagccgagatcacaccactgcacttcagccagggtgacagagtgagactctgtcaaaaaaaaatattagcatgtccactgagaggacaagtgggggtttaggacagggaccctttcccacagcagacctggtttccagcataaaggtctgatggggtggccagggaacaggaaggacctcctccctcatgcccatatcccggtggaatctttcatttttttctgcttcacctaaaaccttgaccttgatttgacctcgggccacatctccaaccttctctaagaatccaagctggaagtccagcttggaatccgagggagcatccgtgtacacagcctacttcaccatccccgaggtgccctccaaactgccccatgaaggaagattctagaaataacattgagcaccttctctatgccaagagctgtttgagctagacatgtgaagatgtcattcacccctagaccctgcaaggtagccaccgtcaagtccacttgacacatgaggaaactgaagcccaaggggtgaggtagttagcccacgatgacagggccagcagatggcaaacccggggtggagcctggcctccccgtagagaaggtgtttaacctcgtggcgcgccttccctggatgggctctgctttgggacagctgggcggatcttcctcccttccacccttacgggcagcttccctccctgtcctcgtcccaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccggtgagtgctggcagcgcagggtgtagggggtggctctccatgggtctggctctgaccctcggctgtctctgcagcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggtaaaaatggggacagggcatgggggtgcattcctggaatcccagcactttgggaggctgaggtgggaggatcacttgagcctaggaggtccaggctgcagtgagccttgatggccccactatactccagcctgggtgacagagcaagaccctgtttctttgttttttgtttttttagttttttggttttttggttttttggttttttttgagaccgagtttcactcttgttgcccaggctggagtgcaatggcgcgatcttggctcactgcaacccccacctcccggattcaagcgagtctcctgcctcaacctcccaagtggctaggattacaggcatgtgccaccatgcccagctagttttgtatttttagtagagatggggtttctccatgttggtcaggctggtctcgaactcctgacctcaggtgatccgcctgcctcggcttcccaaagtgctgggattacaggcatgagccactgcacccggtcaaccctgtttcaaaacaaaaaaaacaaaccgggtggcaagcagtgggtgagggttcctgctgggtgcagcctaggaaccccaagaaaaggagggtcctgctcaagtgctggtgctgggctcctcatgaaggcaggacacctcattcagtgctgaggtcaagagggaacctaggagttcacgcaaatccagggaaggcgtgggctcacctcctggggtcaggactcagggatccagtagcaggacactaccccaactaagctcccagtgagcgtgcagccaaatgcgtaactgtcgggctgttaaaagatgcatgggacacagctggcgggagtgggcagtgcaagggggcggtgagaactcaagttcagaaactgactgccctggcctgcgcccccgccctgctgtttgcagcctgtggacctggggaagggacagggtgctttcctcagtttccccatctgtaacatgaggaagacagcattttctccttcacaaggccattgaaaagatgcaatgagtgttagaacagtgcctctattggtcagagctcaatagcagctattaggattgggtgagataagtcatgtacagaaacagtgttcatgactgggtactgtggctcacacctgtgatcccagcactttgggaggctgtggcaggaggattgcttgaggccaggagtttgagaccaggctgggcaacataacaagactctgtttcaaaaaaaaaaaatttataaactagctgggcatggtggtacatgtctatagacccaactacttggaaggctgaggtgggaaaattgcctgagcccaggaatttgaggctgcagcaagctatgattgtgccaccacactccagcctggacaacagagacccacagagaccctgtctcggaggaagggaggaagggaggaagggaggaagggaggaagggaggaagggagggagggagggagggagggagggagggaggaagggaggaagggagggagggagggtcaggcgtggtggctcatgcctgtaatcacagcactttgggagactgaggcaggcagatcacttgaggtcaggagtttgagaccagcctggccaacatggtgaatccctgtctctactaaaaatacaaaaattagccaggcctggttgtgggcacctgtagtcccagcttgtagtcccagctactcaagaggctgaggcaggagaatctcttgaatccgggaggcggaggttgcagtgaacccagatcgagccactgcactccagcctgggcgacggagcaagactgtctccaaaaagaatattcaatactcccaagcatgtccctcacctcttagctgagagcagccagtgccctgatggcggcagacagctgccgacatattcccagggctgccgacatattcccaggcactacaacatcatagttaagagcacaggccccagaagcagctgcctggttcagctttctggcttgtcacatgttatatggcaagtcttgggccagccacttgacttccctggacctctacttcctcatctgtaaaatgggggtggtgatcattgccatctcatagggtggctgagtgggattaaaggagaacgtgtgttaagtttttaggaccttaccaggcatacattagcattctctattgcgagagaccctgcccggccacacaggatgggtgttgaagttcttctcggagagagttgctggctgggcgtgatcacacatgtagtcccagcactttgggaggctgaggttggggggttgcctgagcccaggagttcaagaccagcctgggcaacatggcaagaccttgtctcttctaaagagagattcctgggtgaaagcagcttccccattctgggcctgtttgttcacaggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagtaagtgaggctgggagctcggctgcctataatgcccatggcaggccactgctgggaactggataacctggcatcccttgtggactgcctgctgccatccctaccctcaaagatctattccctacccaacagatcaggtgacccacttaaaatgtgaatcaggctgggcgcggtggctcatgcccgtaatcccagcactgtgagaggctgaggcaggaagatcacttgaagccaggagtttgaggctgcagtgagccatgattgcgccactgcactccagcctgggcaacaggcctgggagactgaccctgtctcaaaagaaaaaaaaaaaaaaaagcacgtatcagatgtggctcctgcagcctcccatcttgcatgtgataaaacctaaactccttcctgcagctccagccggcctcccccgatttgccttctagcctcccccttccatgctcctcgtccctggaacatgttccagctgacatgttccagccccactggcttcctctgctccttcaatgcacagcttggacccacctgaaggccttttgcaatggctattcctgctgcccagaaagcttccccccgcccctgagctcccttccaggcaggcttctccttctggcttcagcccaaagatcccctccttggggaacacttttctttctctcacagctgaatagcaccctctttgcctggtctctcccacacttgtcactgtctgaaatcctccttgtatacttgttcttttcccactcaagtggcgtgaaagtagggggccgcagtcacgcctgcatttgtccggcctagaatgacactggcttgtggcgcgtataccattctgggttgagttgcgtattgggtgccttctaggggctggggtctgtcctgggcaccggtttggttggtggccgctgcccttggcgctcctgttcctgctctggccccatgccagcctctcacctgcgctccgtctcctccaggcatgaggctcagagactggagcaggaagcccgcggccggcttgagcggcagaagatcctggaccagtcagaagccgagaaagctcgcaaggaacttttggagctggaggctctgaggtgggttgagaactagaggaggagactggcaggggccgagggtcttaggacagcagctggtgtgggcagcaggcctgggtggggtgtcgatgagacagtgcacggctacagcataagccaaggccgtggggggactgggctgtctcccgggtcttacctgactctgccttctccccagcatggccgtggagagcaccgggactgccaaggcggaggccgagtcccgtgcggaggcagcccggattgagggagaagggtccgtgctgcaggccaagctaaaagcacaggccttggccattgaaacggtgagtggggggaggcattaagaagagggtggccttgagtcctggaaaaggcccattccctacagtccctgagactgtataggacaccaggtcccccaacataaagccctatccaagtactttgcatttgcaaagtcctttgccttgtaggattcattgactccattgctggaaggtaaggattagaacacccattttgcagctgggcgctcatgcactggccaccttggcacaagtgctgtgtatgcttcataggcattatcttatttaatgcttgaaatcccattaagaggccgggtgcagtggctcacgcctgtaatcctagcactttgggaggccgaggcgggtggatcacctgaggtcaggagttcaagaccagcttggccaacatggtgaaaccccatctctactgaaaatacaaaaaattagctgggtatggtggcatgtgtctgtaaccccaactacttggtaggctgaggcaggagaattgcttgaacccaggaggtgtggaggctgcggtgagctgaggttgtgccactacactccagcctgggcaacaagagtgaaactccatctcaaaaataaagtaaataaaaataaatgtaaaaagaggcctagtgtggtgcctcaggtctctaaccccagcactttggaaagctgagatgggaggatcatttgaggtcagttcgagaccagttcaagactagcctgggcaacatagcaagacctcatctctacaaaaacaaaattttttaattgactgggtgtggtggcacatgcctgtagtcccagctacccaggaggctgaggcaggaggatcctttgagccaggagttcaaggctgcagtgagtcctgatctgcattccagcctgggtcaaaaaataaagaatgattgatttttcctcttccaggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtgagagttggggaaggtgtgttggtttcaggaccaaccttgaaaccaggaaggcagagccaaggcggaaaacacaacatctggaaagattgtggggaagggaggggtgagtgacctgacccacgatgcagggacattcacacagtgtcacgctgcatcaacgtcaggcactgtactagacccagcagtgagccagagctccggaggagacaggaaatggatgggacgccagtctgacaggcatttccaaggcagtcaagcagggtggtcagatgcaggggaggtgacccttcaaaccagctgacttaaggagggtcactctgaagtggccagggtttgacgcccatctcaacttcctcctgttctcaccctccaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaacacttttctcttgtctgacattggttggggttaccagggagcttaatggtggggaggggaggtgcccctggcatcttttttttttttttcgagctggagtcttgctctgtcacccaggctggagtgcagtggtgtgatctctgctcactgtaacctccacctcccaggttcaagtgattctcctgcctcagcctcctgagtagctgggattacaggcacgtgccaccacgcccagctaatttttgtattttttagtagagatggggtttcaccatgttggccaggctggtctcgaactcccaacctcaggtgatctacctgcctcggcctcccaaagtgctgggattacaggtgtgagccactgtgcccggtcaacatctttagatagttacaggagactcttctcctccataaaggggagaggaccccgaggcaggggaaggatgagctggaagtcacccagtaggaatgtggccccaaagccttgtgcactgggcttcctagagcccagataggggtgatgatgccacgggtgggggcatggggcccacaatggcaacatctcaccactggttctccaggagcccagctgcctggtagctctcagctgttgcagatgcaacccagcttcccattcgggaggcgccctccagcgccacctgctggagcacccacagcaccagcagacgtgtcaggcttgcacccggtgctgtgcgcttgtcccttcccaggtgggggtgtcaggttggggaggaggaccctgcctagggcagtaggaattgggcatctccttgagcttccggtctgggctgtttgggagcactgaaggaggagtgcccttatcccaccttctcccccacaaccagtatggggtcctcatttgagagaaggatccaggtgcagtcagcctgggtgcactagccctttggggccaggaacagttgtaggtgccaggcctgccccgtctctgccgaggaagtaaaaagatcccaggggccgagtgcaagagcttaggcctgtaaccccagcaccttgggaggccaaggcacaaggatcacttgagactaggagttcgagaccagcctgggcaacatagcaagacccccatctctaccaaaaaaaaaaaaaaaaaagcaaaagccagatgttatggcatgcatccgtgttcccagctactcggggggctaaggtgagaggattgcctaagcccagaagttggaggcagcagtgagctatgatcataccactgcagtccagcctgggtgacagagggagaccctgtctctataaaaaaaaacaaaacaaacaaaacccttaaagcctccctaaagccctcattttcaccttcctgtaatattgagtggaaaaagcccgatccccccttaaaccacctccctccctctctgccctgcccctgaccgttgctgcaggaggaacaccccacggagctgactgatcttattttaaactcatgggaacaaattttgagggaggtgcagcttctctggctgtgctgctctgtcttgtgtgcgatccgctttgagacaaccattcacaccacctctcctctcagcctcctacacccctgcccactttctctcacctctttgagaaaatagaagcaaattgggtaggaaggcccttcccagcaacaaacctaacaaactgctggcatctagactgtcctccctcctcttcccaccctgggctcctccccttgggctctaggagagagggctgcattccttcactgattgccgtcctctcctgtgctgtcaatttttttttcttttttttttttttcttgagactgagtctcgctctgtcacccaggttggagtgcagtggcgtgatctcagctcactgcaacctctgcctcctggattcaagtgattctcctgcctcagcctcccgagttgctgggactacagtcatgcaccaccatgccctgctaatttttgtatttttggtagacatggggttttgccatcttgtccagactgatcatgaacccctgacctcatgatctgcctgccttggccccccaaagggctgggataacaggtgtgagccactgtacccagctgatatgccatcaatttcttctctcctgcatcatcatcatcaggatatagacatgtctactctgtccatataaaacaactcccttaaccctatgagcccctctaacttccacctctcctttttccatcacagccaaatttttccagagttctctgtggtctcactttccattcctcatctctcattatctcttcaaaccactccagatagggccaaacgtggtggctcacgcctgtaatcccagcactttgggaggccgaggtgggtagatcacctgaggtcgggagttcaagaccagcctggccgacatggtgaaaccctgtctctactaaaaatacaaaagtgagccaggtgtggtggtgggtgcctgtaatcccagctactcggcaggctgacggaggagaatcgcttgaacctgggaggcagaggttgtagtgagcgagattgcgccattgtactccagcctgggcaacaaaagcaaaactccgactcaaaaaaacaccccagtttgcttctgtctctgccccttactttatggaaactgctttattcggcatcaccagtaatgtcccgttgctaaatccagtagttgatcggtcacttggcacagttggccattcctcccatgctgggctttcctgacatcacctgttctagttttctttctcgcttctctcagtaggttccctaaggcccacttctcatgctgacattcttgtccaatcgcatgacctcagatggtctctataccactgacctcagaatccattactccagctccgacctcacccaagagctctggactcatttccaatccatgccttgatgtctccacgtggacctcaattggtgatcaggctttggctcttgccaatgaaatgcaaggggaaatgacatcacatgcctgttcttcccttttccatataaatgggtgaccagcaatgttccaagtggaagctgctccaaccacctgggtcccagggagaaaatggcatgaggtgcagccacagctgacctgcaacagacatgtggcaggagtgagaaatgtttgctgtattaagcaacggagatttggggggttttgttaccacagtataacctagcctatcctgactactttgtgtgcctcacaggattgtaagatctcataggtcataggggaaactcctctaaattgtatgcaaggggccaggtgcagtggctcacgcctgttatcccagcactttgggaggccgaggtgggtggatcacctgaggttgggagttcaagaccagcctggccaacatggtgaaaccccgtctctactaaaaatacaaaaaaaaaaaaaaaaacacaaaaaaaactaggcgtggtggcacacgtctgtaattccagctactcaggaggctgaggcaggagaatcgtttgaaccccggaggtggaggctgcagtctgccgagatcgtgctactgcactccagcctgggagagggcaaaactccatcttaaaaaaaaaaaaaaaaaattatatgcacgaagaggggcccagcacaggccatagagtggggaagacaggacttgctggaaatacagtgagcttctgtctccaaaaaaaaaaaaaaaaaaaaaaattagattaatttttttttaactttacatttttaaaattttaattattaggtttaacctcaaatttttttttttttttttttttgagacagggtcttgctctggcttggtggttaaatattttgaatttcatccctggggcttagggttgccccaagcaacctgtttactgaaagaagcctgaaatatacattgaatttttttttctttttagacagagtctcgctttgtcgcccaggctggagtgcagtggcatgatctcggctcactgcaacctctgcttcccaggttcgagcaattctcctacctcagcctcctgagtagcgagaattacaggcgtgtgccaccacgcctggctaatttttgtattttttgagacagagttttgctactgttgcccaggctggagtgcaatggcacaatcccggctcactgcaacctctgcttcctgggttcaagcgattctcctgcctcagcctcccaggtagctgggattacaggtgcctgccgccacacccaggtaatttttgtatttttagtagagatgaggtttcaccatgttggccaggctggtcttgaactcctgacctcaggtgatctgcccgccttggcctcccaaagtgctggggttacaggcatgagccacagcgcctggccctagttttttatatcttaaaaattaggcctatgtctaatccaaaaaaagtgtttttagattaaattagctaggtgtggtggcatgtgcctgtagtcccagctactcaggaggctgaagtaggaggatcacttgagctcaggaatttgaggctgcagtgagctatgacggcatcactgtactccagcctgggcaacagagtgagaccctgtctcaaaaacatacatagagaacagtgtgatctctgaagaagttcaacacagcctgtttttctctagcactagaacaaatggcttttctttggttgaataccaaagtaattgatgtgttgaaggaccccctttataagaaaaatctgtgtctttcaacagcgaacacattcagcatggtaagatgctgtttaccgaatcagtttcctcttccacttacgcccacaactaatctgtgtcccagcttcccttgtcctcagacactgccgtgtgaccgagttgtagccaatggaatggaagtggaagtaataagtgctaatttcctgtctttccataaaaacttggctcctgcaacctccatacacatcatctgcctacatgatgcaaacaagctgggcagtcccaggagccacgtgttgaaaatggcagaatcacagaacaggagatgcccgaattcctgaatcgccgcttgcaggagagctgtctcccagtcggcagcatctgattaagatttaatatgagttagaaataaaataatgttctttcttttttttttttttttttgagacagagtcttgctctgcctccaggctggagtgcagtggcacggtctcggctcactgcaacttccgcctcctggttcaagtgattctcctgcctcagcctcccgagtagctgggactacaggcgtgcaccaccacacccagttaatttttgtattttttgtagaaatgaggtttcaccatgttggccaggctggtctcgaactcctgacctcaggtgatcccccacctcagcctcccaaaatgctgggattataggtgtgagccaccacgcctggccaactctttaactcttttgtagcaatggggacttgctatgttacccaggctagtctcaagctcctgacctcaagtaatcctcctgtttcagcctcccaaagtgctgggattacaggcatgtgccaccacaaccagtctagaaataaactatcatgtttgaggcactacacatcttgaagtttgttacagtagttagggttatttttaatcacagaaggagagccttgaagactgagactgcctagaggaacagcaaatgtacaggtactgatctcctgccctccgaggcgcagtcattgagtggaacaaacaaatgaaacttcttacacagtggcgtggtgatcattcatttattctgaaggcatatagctgattccagaaggctattactgcacatataacgtgactccactatgttccctagatcaaatatagatactccagggcccaggtcagctcagcctttccccactccccacctccagatcaagggctctgcaggttcttcctgagcccaggccagccactggacatggaacgccggcaccagtctgactgcgagccacgtccctgtaggccaaggggacttagaagccctcctgtgagtcttcagtgctaccctacaagcctcaggatgctcgggtgcagattcttttagactgcccgtgctcacactctcctcctcaactctcttttttaagatcacatatggccaggtgcaatggctcacgcctacaatcccaccactttaggaggccgaggcgggtggattacctgaagtcaggagttcgagaccagcctggccaacatggagaaaccccatctctactaaaaatactaaattagccgggcgcggtggcgggtgcctgtaatcccagctactcaggaggctgaggaaggagaattgcttgaaccccaggggcagagattgtagtgagccgagattgcaccactttactccagcctgggctaaagagtgaaacttctgtctcaaaaaaaaaaaaaaaatcacatatggccaggcatggtggttcatgcctgtaattgcagcactttgggaggttgaggtgggaggatcacttgagcccaggaattcaagaccaacctgggcaacataaggataccccatctctacaaaaaaatacaaaaatagtgtgctgggggtggtggtgccgcctgtagtcccagctactcaagaggctgaggctggaggatcacttgagcccaggaggcagatgttgtgatgagtcgagatggagctactgcactgcaacctgggtgacagagtgagaccttgtctcaaaacaaaacaactcaatgtagctggatttacacagtcagccttctgatgtcactgtaaatggttagagccaaggagcctaggagccagccagggacatgggagtcaggcaggccaagggctctgtcctctggggctggagagagaggacccaccaggctggaggaagagccaacaggaaggagaaagggctgcagggcaggcacagggacagcccctgacccagtctcctaccttgactgcagcaggccaggtagtggggtgcccacagctggaaacgcacctcagttttttgttttttgttcttttgagacggagactcatctgtcgccaggctggagtgcagtagcacaatcttggttcactgcaacctctgcctcccaggttcaggcgattttcctgtctcagcctcccgagtagctggaactacagtaggcgcgtgccaccacacccaggtaatttttagtagagacagggtttcaccgtgttagccagggtggtctctatctcctgacctcgtgatctgcccaccttggcctcccaaagtgctgggattacaggcgtgagccaccacacccaccgcacctcagttttgtgcaccaatagcttcttcaagcacaggtctgtccctgccactgtcctgctttaagcccctcaacgttcatcctatacgtgtcccccaaaaagcgcgagatgatttaccgcagcaccattcacagtggtaggaccaggttaaactgaatttttttttgagacagagtctcactctgtcacctaggctggagtgcagtggtgcgatctcagctcactgcaacctctgcctcccgggttcaagcgatcctcctgcctcagcctcccgagtagctgggattacaggcgcctgccaccacgcctggcgttctatgcaaccattcagaagcccgctggcgtgaaagtactgcgtacaattaagtgttcaggtacaggctctggaaccagactggccaggctgccacctctcggggcctgtttcctctctggggaatgagaacagtaacagggctgtcgtattgtgtgcaactgtacaattgtgagataagataatgcacgcaaatagcacttagagcagggtagcttgtgttagcagaacagcacatacataaaatgaatgttaagatatggaaatgggctagacacagtggctcacacctgtaattctagcgctttgagaagccaaagcaggaggatcacttgaggccaggagtttgagaccaacctgtgcaacacagtgatacccccatctctacagaaaaacataaaaattagccgggcatggtggtgcatgcctgtagtcccagctgttcagcaggctgaggcaggaggactgcttgagcctgagaggtcgaggctgcagtgagctatgatcatgccactgcactccagcccaggtgacagagagagaccctgtctccacagtaaaattttaaaaagtcctctgggctcctaggccgccccagctggcttctgcgtcgcctctcaccagctctcccagcccccaacccccactcccccaacctccctggagcacttggtgctccaggccctgtgacctagatctgtttcttttttttttccccaccttgactggagcaggccaggttggcagggatggtaggggtgcctgatgcgcttgaaacacacctgctttgtgcacaattttttttttttttttttagacggagtctcgctctgtcactgggctagagtacagtggcatgatcttggcttactgcaacctccacctcctgggttcaagcaattctcccacctcagcttcctgcgtagctgggactacaggcgtgcaccaccacacctggctaatttttgtattttttgtagagatggggtttcaccatgttggccaggctagtctttaactcctgacctcaaatgatccacccccttgggtggatcccagagttctgggattacaggtgtgagccactgtgcccggcctagatctgttccaatttctgttgtcactgtaaatggttagaaccaaggagcccaggagccagtcagggatgtgggacccaggccgaccaagggctccgtgctctggggctggagagtgctcagaggacccaccatgccggaagaagagctgacaggaaggagaaagaggtgcagagcccaggggcctctctggcctccctgccttcccatgccattccctcagctaagaaccaatctcctctgcactaaccctttcctctccaatccctaccagccttctacatgggatacccagccccttcaccaaaccctaaatcaggtcctaggtgtcttctactcccacccccaacgagcactttcctatgttattgtagaggaagccagctgcccagtacccagtgaatcccctgggcctagcacaggagttgaggctcagtacatgtctggtaaatttctgctctcctggacacgggggcctcttgggccacttggctaagctatcatgcagatagaatgagtaacatctgcaaagaacccgcagcacagagtctggcatgcggtacagtagtttaaaaaccacagatggcaggggatagatgcccagaacagtgcctagtatatgataggagcccataaaaagagggaacagtgtttctcaacattactggaagaattccccggcattcaagttgcaggtttctgagcccatccctagagcttctaactctgaaggttggctgcagggtccaagaagttgcatttattttattttttgagacatcttgttttgtcgtccaggccggagtacagtagcatgatcatgactcactgcagccttgacttcccaggctcattcaatcctttcactgcagcctccccagtagctgggactaaggcacacaccaccacacttggctaatttttgtatttttttttttgtagagacggggtcctgccatgtgacccaggctggtcttgaactcctggactcaagtgatcttcccacctcagcctcccaaagtgctgggattacaggccaggcgtgagcctccaagacgggccaaagttgcttttttttttttttgagactgcctggctctgcctcccaggctggagtggcaccattacggatcactgcaacctctccctcctgcctcccaggctcaagccatcctcccacctcagcctcctgagtagctgggaccacaggcatgtgccaccacatttggctatttttgttattttttgtagagatggggtttcaccatgttggtcaggctggcctcgaactcctgtactaaatccacccaaccttggccttccaaaatgctgggattacaggcatgagccaccacacctggcttgaatttgcattttaaagaaatatccagccaggctttgtggctcatgcctgtaatcccagcactttgagaggctaaggtgggaggatcacttgaggtcaggagtttggggctgcagtgagctatgattgcaccactgcactccagcttggacgacagagtaggactctgtctctaaaaaaaaaaaaaaaaaaaaagaaagaaaagcaaaaaagagaaatagaaatataccacaggtggtctaaggaccacactctgagaaaccaactcattgacagacgagtatttattaagcagctactatatgccaggttcaagttggtcttactctagggatagagaagagaacaagaaaagtctgtgccttcatggagtttacattctagtgagggtagaaaatatcaagaatataaatacatgtagacagtcagtgacatcaaacaagtgggcggtggggacaccacatgagcatgggtggcaggagggcctctctgtgaggtcactgtgggtagacggagaagccagccagcaaactggaggaaaagcacccagacggacgtccttccctaagctccctcaacccaggccctgagccaagaatatctgaaaggaaaccaagtcaaatagtgaagtcccgccaggaccagggtaggcaggacagaggagccggtgacagggaaggctgtggatggcttcttccctcctgggcatggtgccccaagcttgctctggctgggggcggaggtctgactcccgcctttcaggaaacctggccctcacaccacctccctcactcaagcgtccctagcatctcggaccccaggactgagcaggcagggtgtgacactgcccggtcccggcaccccaggagcaccgcctggatggagggggcctcccgcgtatcctccctgatttgaggcccgggtcctcaggatcccagagaacgtgacgtcaccaaagagaggctgacccccatcccagcaggtagaacaacacatgaggaaggcgtgagactgggacctcctagcagggggtggggagctgtgtggcacagcaagactcccagggcaggtgggcagccaggacccggggctccagcgtcacttcttcttggcgcggtctgctgcgtccagggcagccatgttgcgggcggccgtgatcaggtggatgacgctgatgagcgacttcagcaaggcgatgggggcagtgacccagaggcccatccggaacagtcccacagagccaactgcaggaaggcagcaggggagtttggggcccgaaggagggggcctccatctccctgggcaggccagatccccctcccatcctcctgcccagcccctcatctcctacctaaaggtccctcagagaaatggaacaggtagaggaggcagtagaagagctcattcccagcacacaaggtgaacagagcaggctgcacacacagcaaacaggccacgttagcaagaggcaggcgtgtgccaccccctgcccccccagcactaatgaaggcacaatctcggcatattacttctcttatttttttttcttttttacagacagggtctcgctctctcatccaggttggaatgcagtagtatgatcatagcactgcagcctcaaaactcctggtctcagccaggcgtgtggctcatgcctggagtcccagcactttgggaggctgagacaggcggatcacctgaggtcaggagtttgggaccagcctggccaacgtggcgaaacccctctctactaacaatacaaaaattagccgagtgtggtggcacgtgccggtagtcccagccactcaggaggctgaggcacaagaatcgcttgaacccagcaggcagaggttgcagtgagccgataacccgccactgaactccagcctgggtgacagagcaggactctgtctcaaaaaaataaataaataaataaataaacccttggtctcacgcaatccttccaccttagcctcctaagtagagactacaggcgtgtaccactgtgcctggctaagctaattcaagattttgtgtgtgtgtggaaacagagtctcactttgttgcccaggctggtctcaaactcctggcctcaagcaatcctcccacctcagcctcccaaagcgctgggattacaggcatgagccaccatgcccagccattatctttttaaaaatccttccagaggctgcctgtgttcctggaatcaagtccacactccagccctgcagacctctctggcttatctcccttcccgctttcagtcccttctctttgcaggcctcattcccacttgttccctggagtaattcacacaggccttccccaccaatcctcctcctccacgcctcagcttacgggccctcctcctggagtgactgggcaggccctgctctgcgccctcgccttctcctaggctaggaccaggattcagcccagggcttcccacagccaagagcctgaggggtggggtgtgcaggaaatgcttaccctcgaggtgtagtagatccgaagcaccggattcccggacaagtcgatcatcttgtgactctcactgcctcggaccacagaacttggggagaaaacaggggaacccacaaggtttcatgaccactaccatgcatccaatcctcatgttaacacctattgtacagatggaaaactgggcacggctaaggaccagtatcctgccgaaagccacagttacctatttgggggcagagtcaggattcaaatgccacatttgaaagctcccatgccccttcctataagctgtcacctatatggaatcctagaatacccagccagaagagtcctaagaattgcttaatgcaactgtaaacatgactgaagctttaaagagaggcaggtttgcctggggtctttctacaaagcagagctaaaaaggagcccttccaggatgcctagtgccatcccagacacccttccgtctaggctcagcccaccccactgtaatgtctccaagtggcccaggcccccagaatcgcagcagacctgtggaggtgcagccagtgactggccacatccaaactcatgctgatttggaagaacagcgtggctccagggtacagcagggccaggttgaccaacaggcacatggtggagcagcggtccgtcagcatgtccagcatggccccaaaccgggttcctggaagattaggtgggcaagggctgttatggcacagtggatgcaggacaggtgcccatatttggtttatcactctgacgcagggtgtaaacgaagactggaagtgtccgcctgcctggggaggaacgcaggctagaaaacaggctgtgtgtgaggtcagtgggcaaaggtcaccatggcatgaactgagaaaggcatgagagtggagggaacagggtaggaggagaggaaagctatgtctgcaactcatcaaccccagaaccaagactccagggctagatagagacttgatgcctcaggggaagccttacagttgggtctggagaacagattaaaaaattagtcaaccctccagaagccatcacccttccctctccatcctccctctaagcatgccttctggaaccccaactgcttatgcagggcacacagtaggcctccagtaaacacctgttgaatacactgttttttgttttttgtttttttttttccgagacagagtcttgctctgtcgcccaggctggagtgcaatggcgcaatcttggctcactgcaacctccgcctcccgggttcaagcaattctcctgccttagcctcccgagtagctgggattacaggcacgcgtcaccaagcccgctaatttttgtatttttagtagagacagggtttcaccatgttggccaggctggtctcgaactcctgaactcgtgatccacccacctcggcctcccaaagtgctgggattacaggcgtgagccaccgcccctggcctgaatggacttgtattcagagagacctccagcagcgccaccgccatgtcatgtcttgctaatccacacctctcacaagcagtgagttctcaagagctagcttaaattccttttgctacaaaatcagtccattcttgctgggcgcggcactttgggagcaaggcaggaggatcgcttgaggctaggagctggggaccaatctgggcgacactgcaagacccagtctctacaaaaatttaaaaattagccgggtgtggtggcacgctcctgtagtcccagctagtcaggaggctgaggtgggaggattacttgagcccagaagatgggggctgcagtgagccatgatcgcgccactgcactccagcctaagtgacagagcgagaccctgtctcaaaaacaaaaaaacaaaacacaaaacaaaaagccccaggccatcctgttctgctttttccagagatgggaatgacagccctctgactctgaggtcccgaggaggcaggggaagggaggaggggattgttgaaccccaaggctggctgagaggggtgtctgtcaccttgattaagagcgcgagcagcgtgtccatcgaaagcgtccagcaggccgctgagcaggtagaaggaggaggccgtgagggggcagcagggcatgaagtagaaagaaatgatggcgaagacaatccgggcataaccttggaacgggacgcggggagacagggcaggatcagggagcccgccaaggcccctcgccctctcgttcggcccggggccgtgggcagcactcaccgatgaggttgggcacgaacaggaagatattttcgtctggcatcgcggcgcctcccttgctgccccgggcctgctctggagatgccagtgctgtcccagccccgcagcgcggcctcagcctccggcccggcgcatcggccgcaccacctgcgccctggaccccgccgccccaacctggccccagatgctgaagcccgcagccgtcgggagcatggaccggccccgaggtgcgcgggacgcagggggcgcgcgcagtccgcccttcctacccgcaacctccctcgcctctgccagccccgcaggcgctccgggcctccagctgcggtcgccgctgctccagctgcgcgtggcttccgggaacctcctcctccgcgcccgtcgttgcaaaattggagagaggaaaaagtggcttaaaaaaatagttgcggcccctttaaggcctgtcggcttcctttcccttttcctccctccgcccctctcccttggctcgtaccaaagcgcagaggaggagagggaggaaggaaccattaacgtcaagcaaagttagaaacggaaaaggaaagggtaaaagagaagaccgaataaaaatctctgctttccttttgtggagggtatgacttcctggaggcaaagataaggcgataaaattcctcctcctgagtctttgcgtccccaagaggccaggagatttggtgcagtcctcactttactccccgccccctaagtctccagccgcctttgctctcgcaggctctaggcggctagagaggctccagagcgccctgcagatgggttgcttttcgcgtgccccttgtgatgggaggattaggtcgcaggctccaccctacgtcatcctcccaagcttctcaagcgtctggcgcttggggtcactgccctcaaggaggcacctggaggggtacggaggggaggctggaggagcaaacggggcgcgctaggaaattcctctgtctttagttctagaacccctgatctcctagcaacgaggctgcggaacctctgcagactccaagggttttatagcgtccggtagcgacacggagccggctcccccttttccagccttcctccccatctcccattctccatcccccacgacctataccagaggtccttaggcctccacgtctctccttttgccgagtagcccaaggtttccacccatctgccaggtctggggcgtcaagtcggctgcctcggcttgggaaggtgcttgggagggaagaaggaaggagaggcccaccaggcgaaggggtgaggggtagggggttgcgggagttccctctcactcccgaagatataaagcaacctttattattattattattttttcttgtgagagggaatgaggcagcgggatgtttcctctaaaggccttgtttaaacctgggcccggggaatggtggtggactgggttctgggggaaagcgggctggtttctcaggtcaactcaggcttcgactgttcccagggggatggcgtccactccgatggggaatgagggggagaagaagagcagctggccatctcaagctgcaccctccttgagaggaggtccggtgagcactgcagggaaccctagaggtgggaatgtaatgaagtgaaagcctcccaggcagaggcaccccgtgccaggtctgagccacgggccctgagactctagcctcaaccctgagtcctgaagccccgactcatagctctcagcactaggccctgactctaaacccccaccaaacccccctcccccaggtccagagctttctagctaaatctcaaggcccagtccttcaggagcaagctccttggacccacaggccccagcctgggaactcccacagccagcactcccatgtgggagctcccaggctgaacccctccggcttttcctttcccaggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcggtaaccccctgcctcaggaccaccgtgtctagagaaccgctgcccccactatgcctggttacagtccctgacccctcccacccctagctgaactctccaggagtctgtgcccatctcatccatctcacagccagccctaggacctgtgaaatgcccctctcacccgctaacccagtacccactcctcactgctggccgagaatccccttagccccgtctgccctggccgcatctcttctggccacggggatagtcctttctctgactaggtcctctacttccagcattcttcaccaagacctgaggcacagacacctggtgagtgaggcttcaagggagatgctctttgtcctgggagagaggtgaggaacctggaggggagagagtgagggtttcacaatatcccagcagggtgggggaatttttgaaccgtgcacttccattctattctgccctgatcctcaaattctgaattctcagccctctcccctctcttccaccatctcctgctcggacagaaaccgtacctgcagcaaggcatacctcctgccaactcctggtgaaaaggtacatgcagggtccatggctgccaaggctattcgatattaaccaaaccttttgagtttgcactatatgttggtccctgtcttaggagcttgggacactgaaatgaatggtacagtctcagcccttgaagagttcacagttcagtgtggggacagacaaggaaatggccaattataatacagtctggataagtttccataatagaaatggacacagtgggatagtactcttatcccagcttcaattggacaggaaggacaggagccatggagcttcttctttttttttttgagacggagtcttgctctgttgcccaggctggagtgcagtggtgtgatctcagctcactgcaagctccacctcctgggttcacgccattctcctgcctcagcctcccaagtagctgggactacaggcacccgccaccacacccgactaatttttttgtatttttagtagagacggggtttcaccgtgttagccaggatggtcttgatctcctgacctcatgatccgccctccttggcctcccatagtgttgggattacaggctttggagcttcttgaaggaggtagcacctaaagaaataattttccaccaggtgcagtggctcacacctgtaatcccagcatttttgggaggctgaggtgggctgatcacttcagggcaggagtttgagaccagcctggtcaacatggtgacagaggttgcagtgagctgagatcataccactgcactccagcctgggcgacagtgagaccatctcaaaaaaaaaaagaaataattttccaggttaaaaaaaaaagaggttagtaggagtctttcaagcagttggggttgcatgaacaaaggcaaagagcagtcttcgcagagccagtgtgagcatctgtgtgtatttagggcagggagaagcagtttagcagctggagtctacaggcaaggtaagaggggactcaagagactttatgtgccttgtttagagccttacacactttcctggctgggtgtggtcgcttatgcctgtaatcccagcactttgggaagctgaagcaggaggatcgcttgcgtccaggagtttgagaccagcctgggcaacatggtgataccccaggcatgatggcatgtgcctgtgatcccagttacttgggaggtgggaggatcgcttgagcccaggagttcaagaatagcctgggcaacatagagagaccccatctctataaaaagttaaaaaaattagccaggtgtggtggcacgaacctgtggtctcagctacttgagaggcggaggccagaggatcacttgagcctaggaggttgaggctgcagtgaaccatgttcatgccaccgcattccagcctgagtgacagtgcaagaccctgtctcaaaaagaaaaatttaaaaaaaagaaaagaaagaaagaaatagtaggaggagctgggtgcggtggctcatacctgtaatcccagcactttgggaggccaaggcgggtggatcatgaggtcaggagttcaagatcagcctggccaacatagtgaaaccttgtcttaactaaaaatacaaacgttaggtcaggcgcggtggctcacacctgtaatctcagcactttgggaggcccaggcgggcagatcacctgaggtcaggagtttgagaccagcctggccaacatggggaaaccctgtctctactaaaaatacaaaaattagctgggttggtggtatgcacctctaatcccagctactcaggaggctgaggcaggagaatcgcttgaacccaggagttggaggttgcagtgagccgagatcacaccactgcactccagcctgggctgcagagcaagactctttctcaaaaaaaaaaaaaaaaaaaaaagccaggcattgtgtcacgcacctgtaatcccagctacttgagaagctgaggcagagacttgattgaacccgggaggtggaggttgcagtgagctgagattgcaccactgcactccagcctgggccacagatcgagactctgtctccaaaaaattaaataaataaaaattaagcacttactatgtgccagcactgctcgaggggctggggtgttgcagtgaacgaaacagagttcctgctatcaagaggtttaaaaaattagccgggtatggtggtgcacagctgtggtcccagctactcgggaggctgaggtgggaggatcattggagcccaggttgaggctgcaggaagatatgattacaccactgcactctagcctggctgacagagggagacctgtctcgagaaaaataaaaaagacatgagccttgggtctaaagagtgaaaaggctctgtctcttttatggagctcttcctaacagtcagtttggaagatgagcccacccctctttgatgctcttggcttctcatgcctccccctttttgtccctagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgcattgctcatgtgtggtttctctggggtagagaagcaggacgggggggcttttatttttttttctagatgtgggtgctggatgtgggcatacgattggagtgtttagtctttaaaaaaatttttttgtggccaggcacggtggcttacgcctgtaatcccagcacagatcatgagctgaggatatcaagaccatcctggccaacacggtgaaaccctgtctgtactaaaaatacaaaaaattagccgggcatggtggcacgtgcctgtagtccgagctactcgggagggaggctgtggcaggagaatcacttgaacctgggaggcggaggttgcagtgagctgagatcgcaccactgcactccagcctgggcgacagaacgagactccgtctcaaaatttttttgtgtgtgtggagacggtgtctcactgtgttgcccagactagtcttgaactcctggcctcaaatgatcctcctgcctcggcttcccaaagtgctgggattactggtgtgaaccaccacacccggcctgttgacacagatgagctcatgggtccaaatccagcctcctggccacacgccagcaccttaaggtctaggtctgtggcatctggcaggactcctcttgcttctgaggagccacctctgccaccaccattggggatggggacactgagctatggccttgcccctctgagctttgggcttcatgcctgtgagaacatatcacactcattactagccagaaagcagtgcagtaggctttgcagtaggctaaattcattttagcatttagcatttgcattgctaaatgcaaactgcacaaagtttggccatttattggagcctcctgtggaagtcaattctcatctctgagccttagtttccttatctgaaaaaatggattaataaatgatccctgtcccgtagggtcctttagagagttaaaagacataattgagtcaggcatggtggctcatgcctgtaatcccagagacacaccggacagtatggcgggaggatcgcttgaggacaggagttcaagaccagtttgggtaacagagtgaacccccacccctaaaaaggtaaacaagttagccaggtgtggtggagcacatctgtagtcccagctgctcaggaggctaaggctggaggatcacttgagcccaggaggttgaggctgcagtgaactatgatggtgccactgtactccagcctacactacagagacaccgtctctaaagaaaaaaacataggccgggcgtggtgactcatgcctgtaatcccagcacttgggaggctgaggcgggtggatcacttgaggtcaggagttcgagaccagcctagccaacatagtgaaaccccgtctctaataaaataaaaaaattaaccgggtgtggtggcaggctcctgtaatcccagttactggggaggctgaggcaggagaatcacttgaacccagtaggcagaggttgcaatgagctgagattgcaccactacactccagcctgggtgacagagtaagactcagtcgcaaaaaaaaaaaaaaaaaaaaaagacaaaaaaacaacataatgcatacaaagtgcttgctattattgagatcagtttgcctcacattctcctaaaagtccacccctttctgaatatttcagcatcctttcaagtatcctaaaaatgtttaattgcatttaaatataaaattttattttatttgggacggagtctggctctgtcgcccaggctggagtgcagtggcgcaatctcggctcactgccagctccgcctcctgggttcacgccattctcctgcctcagcctcccaagtagctgggattacaggcgcccgccactacgcccagctaattttttgtatttttagtagagaagggatttcaccatgttagccaggatggtctcgatctcctgacctcgtaatccgcccgcctcggcctcccaaagtgctgggattacaggcgtgagccaccatgcccggcttaaatataaaattttaattaggccaggcaaggtggctcacacctgtaatcccagcactttgggaggcccaggcaggcagatcacctgaggtcaggagttcgagaccagcctggccaacatggcaaaacccggtctctactaaaaatacaaaaattaaccaggcatgggtgcctgtaatcctagctactcgaaaggctgaggcaggagaatggcttgaacccaggaggtggaggttgcagtgagccaagatcacgccattgtactgcagcctgagtgacaagagtgaaaaaaaaaaaaaaaaaagataaagtggaaaaggacacccccaaggatataaaacaagttcaaattggtagatgggtcacagcagatacgcctaaaatactaaaaagattgggggggggggaagaaatggtgtacttgaatggatacaaaaattctccaaagggggtgaattttaggcaaactggtcataagacaaattgaaaagccaggcttggtggctcacgcctgtaatcccagaactttgggaagttgaggaaggaggattgcttgaggccaggtgttcgagaccagcccgggcagcgtaacaagatctcatttctacaaaaaatttaaaaattaggcaggcaccatggcttgcacctgtagtcccagctactcaggatgctgaggcgggaggatcccttgaacctaggagtttgaggttgcagtgagctgtgatggcaccactgcattccagcctggccggcagagccaggccctgtctctaaaaagaaagaaattgaaagctgtttgcctcctgcccagcagcgagagaagacgggtggctcctgtcagttctctcccatctggaagaggcccacaatgtcaaggaaggcctggtggagaggtcactgcgtcctggagtgaggctggtcgcagggaggccttcacagaggctgagcctaaagccaggcttttttacctcaggccaggcccccggacactgccctctgcccactttcgcatttcctttttttttttttttttcaaattgttcccctttccccagccctctctccagagaagtggtccagtgctcggtgaccacctccccacactccaccggcccaattacaagtggcgattttctgtttattgctcaaaaacaagaattcagaagcaaaggtggagagactgtgggttggggagatggcaggaagggggcaaggccttgtcccagctctcccctttgtccttcttctgaccctcctggccggagtcaggcctagggccagggcatctgggaggggggcaccttcgtggccaagggaacagtagagctatcgggggcagtccttgaggggtgccctgggcaggaggggctgcaagatttgcagggaggcagagttcccctcccagaatccaaaagccggtagggcggggggcaggcccctcgtttggcaactgagaagaggcggctttgggcggcaggatgctggtttatttactgtaggatctccagggccatcaaagccccctcgtgggatagggagactatttacacagccagggaggagggcagccaggaggcagagaccgggtcccgtatttccctctgcccgaatgaggaggggaggggcgtcctgggtcctgcagctgtagtcttggggttcagatggaaacttcatactcccgcgtatcctgaagacagagagatcaggtcagttgttggagtctgataggggtggaagaggcagccgaatgggaggaggggcaacgatcctgggttttaaagtaacattgacctctaggggctggggggccagtgaatgtgtttggttcatcctacggtgtcgtaaaatgacacaaaaatctgaatttctggcttgtcttgaataattggaagatctgccaattgtgcctcagtttcgactatggggtagagccgtattcttgagatggggcacaagtcctccacttagccacagtcctcaccactccctattgtatacacatggcttgctatgctcattgacatggcctctgggggcagctgagtttgaaattcccaagacagagattccagagaccttgcgagaaggttatggagtcctgggagagccaagtggtggctcttcaggggcaggcaaggtgcttaccccagcttcatacagcgggttgctgaagtccgactccacggtgatggggctgtaggagtgggagcccgagaagccgaaaagggactttccctgaagcctgggaaagggagaggacagaggagcttatcaacaggtaagcccctgagctcccctgacccaggctccagtgccaggctcgcaagacgtctgccctggccggcagtccccaagcaggctacttacttggtgtagtagatgtaaacgccactgccgaggacaatgaccaagcctagaggcagcaggatggccagggccaggttccccccttccagctgccgtgatggatctgtggtctgggtcactacaggaggaggagaggccggtgagctgtggctgggcccggtcctgggctctcccagcctcctgccctgggcctcaaaccctgggcttcatccctccaaggcctggcctcctgccccagcctctgccttgccctcccaacctggccagcctgggtctccacctgtgctctcactgaccttccagttttcggttgtccaggagctcctcataggcaactgcagggagaggagggggaggggatggggtctgagccagggaggggaggaggctgggaggggccgggagcccggtggggctgggctggacagcctggttctctctgccctctgctcaacctcaactttctccctttgtggggaagagagaggagtgaccagcacagggcctttgtcctctttctccagacccctaaaaagtcagggttcctggacagtctgagccaaactagaacttgtcagcgatagggaaactgaggcctattcagagcaagggacttccaagccaaggccccctctactacacccctgagccaatcccatgacctcacacgacccagggcttctggacacacccgtgaggacacgaggccacaggaggagaaccgggagctctgtggggtcgcccattggtctcaaatgtgctacctgactctcccagccctgtcacttcccggacactggtgtgcccctcctgccctgtctggccaggcacctttgcagagtgggggctggctggtccactgggaggggtggccgggcacacaggtgatggtgacctcgccgataagctcaaagccctcatagcagaagaagcgcagagactcgcccgcctggtagtggtgcttgtacagcgtctggtagccattctcgggaacccccgggttcaggcacggctcgtacttcactgcggggagcatgccagtcacgtgccagctgcactactgtgcacggggcagacgggctctcccagggctacccagccaccctcccagggtgtgccccagactcacaggcgcatttggggaccctatcgctccacttgggtgtgcctgtgtcccggctgtagcaggtgagcatggctgccccctcgaggctgtaccctggcaggcagcggtactggacgtgggagccaacggggaagccggcgtccgaggcggtgcggtgcccgttggcaatctcgccagggtcagcacaagtcatgactggtggcagaagaacaaggtcagggggagcgagggccttcaaagatcagcctgggcaacacagagagaccccatctctacaaaaaattgaaaaattagccaggagtggtggcgcactcctgtggttccagctactcaggagttggaggcgggatgatcgctcgaacccagcaggtcgaggctgcagtgaatggtgaccacgctactgcactccagcctgggtgacagagtgagacccagtctaaaaaaaataaaagaaaatctcccagaagcttagggctgggagaggcctgagcctcaggctgtttcctctgaacacctctgcacacacacgcacttcccaccaattcctcagaaggaagagagcatgaattggaaaaacttaaaatgcagtgcatctattttcaggccagaatgacaggcttaatttttttcaaaattcaacgtatgttatatttcaggcttcgtttagtaaacagtttgcttggggaaaccccaagcccctatcctggggtgaaattcaaaatatttaaccaccataccagagcatactagccaaatcccagcagggtgagcccaacatggcttgtagtctgtggaacagcagctgccctctttagagggggcccagctctcctgtccccagtattctcattatgcccagcccagttcactcacatacactccctgccttcaggcgtttgagtttacaaccctgttgtgaaggaatcataatcatagccatttcttgtatataagcctgagctacgtaccctgctaaatgttttacaaacaaatataattctttgtgtgtgtgcttgttttttttttttttttttttttttttttttttttttttgagatgggagtctcgctctgtcgcccaggctggagtgcagtggcgcatctcggctcactgcaacctctgccttctggactcaagagattctcctgcctcagcctcccgagtagctgcgattacaggcattcgctaccatgcccagctaatttttgtatttttagtatagacagggtttcgccatgttggccaggctggtctcgaactcctgacctcaggtgatccacccacctcagcctccaccagtgctgggattacaggtgtgagccaccacggctggccccaaatataattctttgttttggagacgagaacttgctctgtcactcaagctggaatgcagtggtgagatcacggctcactgcagcctcaaactcctgggcttaagcaattctcgcaccacagccttctgagtagctgggactacaggcatataccaccatgcctggctatattttttattatttgtagagacagggtctcactatgttgcccaggctgttctcaatctcctgggctcaagtgatcctcccaccttggccttccaaagcactgcaatttcagatgtgagccaccacacctggcacaaacataatatttaatcctgattatcctgagaggccaatgtcactgtcatctcccttggagcccagggctcagggcggtcaaaggacttggcccatggtcattcagccagggagtggcagagccggaatctgcccagggtcacagccatggagcactggacagggactcagatatgtgggtcctggcacaccttcaggctcaatctgctgccttgggcaggttccctcctgagcccgaggcagcggggccagccgaactctcagccccatccaggcctgatatcctgtgaatccttccaggggcgggaagctttgtccagcccaaatctggctacctgaagcttctccccttggtcccaccattgcttccagatgccacatggaactacagccccatgtccttggggctggcttcctaaaatttggagaaagtaaccagctgccattcctttctgctcttcaattttctttttctttctttctttctttcttttttttttttttgagatggagtatcactcccgtggcgcaggatggaatgcaatggcacaatctcagcttactgcaacctccacctcccaggttcaagcgattctccttcctcagcctcctgagtatctgggattacaggcgtatgccaccatgcccagatagttttttatttttagtagagacggggtttcaccatgttggccaggctggtctcgaactccagacctcaggtgatccaccgcacctggccctttctgctcttctaaaagatacacactcccagctcctttaaatgtcacctcctctgtgaaatctcctgccccagccctgagaaaattagcccactgctctccccacagcacttcgccacgcccagggcagcatgcgccctgtgaactttccatctgctcttcacaacctcagtcctacttcgccgatggggaaaccaagcctcagaaatgctaagtgcctcgcccaaagtcacccagtgatcaccaccctgcgtatccctcccagactgcgagctccataagagtatggaggggcttgaacccccttcgcctaaccccaacccagcacggggcttcaatgatggcattcaaataaaccaagtgctctgacaagccttggtcctagcaaagtggctccctacaatttcaactgataggactgcgggattggggcggggcgtaggacaggaaggtggagccaagtgtggacccggggagcccagtgggaacctggtcggagcccttttaggggccaaactcagatgccgcagaggaggggtcaggaggggacggggcggggccgtgagacgaggaaacagggaccgagcccaggtcggtgcaagaaagagggatgcagcccggagaagatgagagggagacccagaggggacagtttcggggaaccgggcggaggagtgagaactaaagggcatgggggcaggccttgaagaagatccaggaaggaccccgagcgaagggatggaacccagaaagcacgggggtcgggacaggacaggccgacgacggggcccacagggaaggggcggggccgaggggacgcgggcggggccggctcactcttttggcaggcgggcggcgcggcgctccaagacaggtcccactggcaagtgagaatgtcggagcctagcagctcgtagccaggctcgcactggtaggtgagcaccgtgccccggatcaggtccccgtgggatgccgttctccagccccactccggaggtggcagctcggggcacgtgtcgttcctcgggacctctgcaggggagggaaggcgagtttggaggctgcgttttaactgcgggctcccttccagcctcggaggctttgctctgtgccccctcccgggatctgtctctctctctctctcttagagacagggtttcctgtcgcccaggctggagtacagtggtacaagcatagctcactgcagcctcaacctcctggcttcaaacgatcctcccgcctcggcctcccaaggccccgggataacaggcgtgagccaccacgaccggccacctcccgggatctctggcctgcccgacccctgcccatcccgggactctatccctcagtacctttgaagtgcaatacgaagccctggcccaggcctggatttgggggcccgggcggtgcctgaaactgcagtgtgaggtcgggcccagaggagagaaggcggcggcgcggctgaggtccccgcagctgggccaagactcgggcgctgggaccgtccccgtcgaacagcgtcagcatgtccccttcccgcacattcaatctgcagggggtgagaccaggcaatggggcggggctgcgactggcccctcccatccagctctgccccatcctcaactctgctcattggtagcccctcctactctccagccccgcccatattctcctatcccaggtctggcgccgcctccgttttgaccaaccatggtttctcctatgctagtgcctcagggttcccctattctatggctcctcccatgtcctactacccaatccctaagcttgcacattactaactccgcccactgtccactccctcctccatcaccatgagatccacagcctagcccaactccagctctggccaatcacagaccaaattcgctaacgccctacacaactctaggccccgcctgagtacctgctttgaagccacgcccacttcagcttctgtgccatctcatgacactctcataccaattcagctcactggattctccccagacctccccaacttgctggtgttaacgcaacagtttgggtctgtgtccgtggaaatagctccaggggaagcctcagaaacctccaaagagtgagaggcaccaggccagagccccttgttcacagtggcccctaaggaaggctgcattgccctatttatttgtccgaggttgcctggctaatatgtgatttgagcccagctctctcacgtctatcctgtacccttagtgcaccagcctatccaccgaattctggatagatacgcaagagccagacaggctcagaatgcaggctactgcattggcataccacactttgctgagcctacacccgtcgcaccctctgcaggacccaaacatacatctcaacttggagcaagatgcgcttctcttcctggacgtgcacgccccacacgcagtcttggcccgggctatagctctggggccagtcgggagagaggaccacgccagctggttccgacagctcccctccacacatggctagggaaaaaggggtgtcaggttcaggacccaggtgggcatgctgtcttcatttctccacagtcctcaccactcgtgatgcgtgcaccacatcacctcgcttgtttcctattacctatgatccacctgtttcttttattcttttattttatttatttatttatttttaaattttttttgagacggagtctctctgtcgcccaggctggagtgcagtggtgcgatcttggttcactgcaagctctgcctccctggttcacgccattctcctgcctcagcctcccgagtagctgggactacaggcgccgccaccacaccctatttttttttcttttttctttttttttttttttgtatttttagtagagacggggttttacggtgttagccagaatggtctcgatctcctgacctcgtgatctgcccgccttggcctcccaaagtgctgggattacaggcgtgagccaccaggtccagcccctatttttatttttttagacagagtctcactctgtcgcccaggctggagtgcagtggcgcaatcccggctcactgcaatctccacctcgcagactcaagcgattctcgtgcctcagcctcccaagtagctgggattacaggcacgcactaccatgcccggctaatttttgtatttttagtagagacggggtttcactctattgaccaggctggtctccaactcctgacctcaggtgatccgcctgcctgagcctcccagagtgttgggattacaggcgtgagacactgctcccggctttatccacctgtttcttttttctttctttctttcttttttgagacggagtttcacacttcttgcccaggctggagtgcagtgctgcgatctcggctcaccgcaacctccgcctcccgggttcaagcgattctcctgcctcagcctcctgagtagctgggattacaggcatgcatcaccatgcccagctaattttgtattttaagtagagacagggtttctccatgttgatcaggctggtctcgaactcccgacctcaggtgatccgcccgcctcagcctcccatagtgctggtattacaggcgtgagccaccgtgcccagccatgatctacctgtttcttgccgcatctaggtcctgttgtgttcaatatccagtcctgctcttaacaaaccctgcccactctccagcctgcccaatctgtgacttaacccaacagcagttctcgctcttgaagacatttgggtttgtgacccctgcattcagtaacaagcccagcagttattcagctaagaaaacagcctctgaagggacagggatttacccaaggcttgggtggatgaagtctggatgtgcagccttcctttctgaacggccttgctgggatccccagttcagggggcaacgtggactgaaggacatgcctgcgacaaggaaggctcacctttgcaggccggctctgtgtcgttccagtggggttctgtgggatccacacattcgatggcattggggggcccagggggctccagggcatatcctgggaggcacgagaaggttgccagtgcccctgggcgatactcagggtccgtggtagtgacatttccatgtgccaggaagggggcgaagcagcgatcctcctcaaaggctgggaaggagtcagtcataacaattaagcattaggacaggcctcaagggatcttaaattggggatgtgggctgaattggggtgttctttggccactcactgggcttttttttttttttaaacagtcttgtgctgtcgcccaggctggagtgcagtggtacaaccttggctcactgcagcctctgacttccaggttcaagcaattctcatgcctcagcctcccaggtagctgggattgcaggcgtgcaccaccatgcccagctattttttttttttttgagatggaatttcacacttgttgcccaggctggagtgcaatggcacaatcttggctcaccgcaacctccgcctcctgggttcaagcgattctcctgcctcctgagtagctgggattataggcatgtgctactacgcctggctaattttttgtatttttagtagagacggggtttctccaggttgatcaggctggtctcaaactcccgacctcaggtgatctgcctgcctcggcctcccaaagtgctgggattacaggcatgagccaccgtgcctggccaatttttgtattcttagtagagacaggggtttcaccatgtcggctaggctggtcttgaactcctggcctcgagtgatctgcctgcctcagcctcccaaaatgctgggattacagacatgagtcactgcgcccagcctgggtttttttttaatttttttagagacagggtctcactctgttgcccaggctggagtgcagtggtgtgatcacagctcattgcagcctagatcttctaggctcaagtgatcctcccacctcagcctctctggtagctgggactacaagcatgcacaccccacccagcagctcattttctgattttttttttttttctgtagagatggagtttcaccatgttacttaggctggtctcgaactcctgacctcaggtgatccgctggcctcggcctcccaaagtgctgggattacaggtatgagccattgccctggcgttggtgggtttttaaaaactgaatgccactgggtttagcattcactctccagactgtcaaaaaaagttctaacactcctcattcacatatttatattgcctccctggcctctggagggaagccactgagctagccaaatcccagccaccattctacagagcggaggtccatagaccaaaaagccacttgctcaaggtcacacaaaagacaatggcaaaagcaggtctcaaacccagatggtttgattcccagccacagatacttggctctggaaacagcagagatagcgggtaaggggaggggtgccttcagagaactggctggtgtaggtgtattgtctcctcagaaataacagttggattctgatcatccatgctgttgctgaaacccaaaatttcagctaatgcaaaaactactcagtttttacttcaagtcagcaaaagtgaacatttgtagagcatttgagtttctgcccacctgatcggatcttagctgcaaaactccctgtaagttaagatttaggtgcctatgataccaatgaggaattcttttttttttttttttttttttttgggatggagtttcgctcttgttgcccaggctggagtgcaatggtgtgatctcggctcactgcaacctctgcctcccaggttcaagtgattctcctgcctcagcctcccgagtagctgggattacaggcacccacaaccacccccggctaatttttgtatttttttagtagagatggggttttaccatgttggccaggctggtctcgaacacctgacctcaggtgatccacccgcctcagcctcccaaagtgctgggattataggcgtgagccaccatacccggccttttttttttttttttgagatttttaattttattttaatattttatttttttattttttgagactgagtctcgctctgtcgcccaggctggagtgcagtggcatgatctcacttcactgcaaactcggcttcccaggttcaagccattctcatgtctcagcctcctgagtagctgggattacaggcacgtactaccacacctggctaatttctgtgtttttagtagaaatggggctttgccatgttgcctaggctggtttcaaactcctgggctcaagtgatccacctgcctcagcctcccaaaatgcggagattacaggcatgagccactgtgcccgggttattttatttatttttaaaaatgaggccagatgcagtggctcacacctgtaatccccccactttgggaggctgaggcaggtgaatcacctgaggtcaggagtttgagaccagcctgaccaccatggtgaaactccgtctctactaaaaacacaaaaattagctgggcgtggtggtacatgcctgtaatcccagctactcagaaggctgaggcaggagaaccacttgaacccggaaggcggaggttgcagtgagccgagattgcgccattgcactccagcctgggtgacaagagcgaaactccatctcaaaaaaaaaaaaaaaaggaaaaaaatgagacagggccttgctctgtcacctaggctggagcgtgcaatggtgggatcacaactcacagcagccttgacctcctgagctcaagcgatcctcctgcctcagcctcccaagcagctgggaccacaagtgtgcaccaccacacctggctaattttttgttttgttttgttttgtagagacaaaggtcttgctatgttgcccaggctggtctccaactcccaggctcaagtgatcctcccatcttaacctcccaaagtgctgggattacaggcgttagccattgtgcctggccacagtgaagaatcttaaactcatagaatagcagtggcctacaactctggagtcaggactcacaacttgctattttcggtaaaagatctgtgctgtttgcactttaacactcccagaatctatcccgcaattcatttttgcagatccactgttctatttcactgttacttaacctgcaaggtatcatgtccaaatcctacccatccatcacagccgagtgccaattccatttctcccatgattcatatcaaacactagaccctcctatctctaagcatttcatctttttggtctctctcttgctactgtttatacaactcctctgtttcagccacaatgaaattctgtttcccagacataccaggcatttccctacttgctgtttctcaaagttcctctctttccttttcttttcttttcttctttttttttgacagggtcttgctctgttgcccaggctggagcacagtggtgcaatcatagctcactgcaacctctggggttcaagtggggttcaagtgatcctcccacctcaaccttccatgtagctgggactagaggtgtgtgccaccacacctggataattattacttttttttaatttgtagacacaggatctcactatgttgctcagactggttctcaaactcctggcctcaaacaatcatcccaccttggcctcccaaagtactgggattagagacacgagtcaccacaactggcctcaatcttcctcttttaaaatatcctctgttggctgggcagggtggctcacgcctgtaatcctagcactttgagaggccgaggtgggaggatcacttcagctcagtagttggagaccagcctgggcaacatagtgagatgctgtctctacaaaaaatgtaaaaattacccaggcatggtgccgaacgcttgtggtcccagctactagggaggctgaggcaggaggatcacttgagcccaggaggttgaggttgcagtgaaccatgatcgggccaccgcactacggcctgggcgacaaagcaagacctatttcaataataataataataataataaaataccctctatcctttaaggccaaggtgaaatgcctcttcctccatgatcacttccttgtttctaccccttcacattcattcctcttcttctggtaacggcatcccaattttaattttgggacgcaggccttccccactcccagtccactaggttaagttggagcccaccagggaaggccacgtgaggcagattagccaatcccaatactcccttctcctagctcagtgattggctcaggctaaggccaaccaggatcttagtcaggtcaatgaacgcctctcctggcatttttgctgagctctcaggaaatatatgagtgttctctctgatgaggttactcggttggtggtatgggctggaggaggtggcttacacctgtaatcctggcactttgggagtcccacatgggcgaatcacttgagcccaggagttcaagaccagcctgggcaacatggtgaaaccccgtctctactaaaaacccaaaaattagctgggcgtggtgatgcatgcctgtaatcccagctactcgggaggctaaggaatgagaatcgcttgaacctggaggaggggggctgcagtgagctgagatcgcgccactgcactccagcctgggcgacagagaggaactctgtctcaaaataaataaataaataaaaataaataaaaactaaaaactgtcaggcgcagtggctcacgcctgtaatcccaacactttgggaggcggaggcgggcagatcacctgagttcgggagttccagaccagcctgaccaacgtggagaaaccccatttttactaaaaatacaaaattagctgggcatggtggcgcatgcctgtaatcccagctactcgggaggctgaggcaggaaaatcgcttgaacccgggaggcagaggttgcggtgagccgagatcatgacattgcaccccagcctgggcaacaagagcaaaactccgtctcaaaataaataaaggccgggcgcggtggctcactcctgtaatcccagcactttgggcggccgaggcaggcggatcacaaggtcaggagatcgagtccatcttggctaacacggtgaaaccccgtctctactaaaaatacaaaaaaattagtcgggcgcggtggcgggtgcctgtagccccagctactcgggaggctgaggcaggagaatggcgtgaacccggaaggcggagcttgcagtgagccaagatggcgccactgcattccagcctgggtgacagagcgagactcgtctcaaaaaataaataaataaataaataaaataaaaattaagttggtggtatgtaagtcggcagctatgtccatcacacagggaaagtgcctaaggatgaagccagcacagaggaaagaaccgagatactgagataactggtctctgggctatgtacctggatccagacattcatgaagcttaaacagagaaggctgcctgggggaaggagaaggggtccctagaagagatccttgcagttttggggcagggaagcgagtcacgtttcaaggaacccagcacggagatgaacaggcatagagtttgtgcttccgactatgcttggtgtcaggaagaggggaaggtgtggcggttggggtcctgtgggggagtgggtcacttaccttcaaatcgaaggcttaacagcaggggattggcaggtgtctctgacagcagctccacgtagagggactgggcgtcactgatgagaccccgctcggggacatcgtccatgtccgaatcatagatcacgggggatagggggctgccccctgagcgcaccatcagcctgggatggacagaaacgtgaccaggagctcaatctccctcacaagctgcctcaccccttgcctgctttcctaacttatttttatagctgttatcatcacacataactatatgccacgcactcttctaagcccttacacattctatctcatttaattttcacaagaactcttgagtcagacactattattatcctttattttatagatgaggatattagggcatagaaagatcaagtaacctgtccaaggtcacagagcaagtagtggcagggctgagataccaagttgctaggtaaaggatgataatgatgatgaagatagcagatgcttgaccaggcatggtggctcagctcacacctgtcatcccagcactttgggaagccaagacgggtggatcacctgaagtcaaggagttcaagaccaggctggccaacatggtaaaaccccatgtttactaaaaatacaaaaattagccaggcatggtggtgcatgcctataatcccagctactcaggaggctgaggcaggagaattgcttgcatctgggaggtggaggttgcagtgagctgaatccgtgccactgcactccagcctgggtgacagagcgaaagtctgtctccaaaaataaataaatagataaataaggccaggtgcagtggttcatgcctgtaatcctagcactttgggaggctgaggtgggtggatcacgaggtcaggagatcgagaccatcctggctaacacggtgaaaccccaactctactaaaaaaaaaagtacaaaaaattagccggacgtggtggcacacgcttgtagtcccagctactcgggaggctaaggcaggagaatagcttgagcctgggagacagaggttgtagtgagccgagatcgcaccactgcactccagcctgggcgacagggtgagactccatcttaaaaaaaaaaaaaaaagaggatagcagacacttttatagtgcttattgtcccaggtgccattctaaggactttatataatttcagcacttatcctcacagaaacctgaagagggaagtattgttatctccattctacagatgaggaaactgaggcacaaagaagttaagtgatttgtctaaggtttcacagctacacttcctaagaaagtcttaggactggctgggtgtggtggctcacgcctataattccagcactttgggaggccaaggtgggcagatcacctgaggttgggagtttgagaccagcctgaccaacatggagaaactccatctctactaaaaatgcaaaattagctgggcatggtggtgcatgcctgtaatcccaactaatcaggaggctgaggcaggagaatcacttgaacccgggaggcagaggttgcggtaagccaagactgcggcactgcactccagcctgggcaacaagagtgaaactctgtctcaaaaaaagaaaaaaaaaaaaaaaaaggcttaggactaagctgtgatgcatatctcaaccaggatccaccccagctgtgtccaagtccccacttagcctccctacttccctgaggtggggacttctttttttttttttgagacggagtctcattctgtctcccaggatggagtgcagtggtgcgatcttggctcactgcaagctctgcctcccgggttcacgccattctcctgcctcagcctcccgagtagctgggactacaggtgcccaccaccatgcccggctaattttttttttttttttttgtatttttagtagagatggggtttcaccgtgttagccaggatggactcgatctcctgaccttgtgatccgcctgcttcggcctcccaaagtactgggattacaggcatgagccaccatgcccggccaaggtggggacttctgacccaagacccagacccttaccggtcattgtcctcatccagcgagaccctttcaaagtgcaggtgcagccggcgcccctcagctgcttcaatgacccaacggcaggtgaggttgggccctacggctcccccaggctctggggacacgatgcggcccagggtggcattgtggatggtgccaccacaggatgctgtgggcagaggaggggtacgttaaggccagcctgaggtgaactgtccttctcctcggggcctcggcccgttttcagaactgttgcattcacacatttggctgggacccggcccagggctggcctctgtcccatggagtcactccagaggatgggaccttctccaggcatgagccaggaaagaaaccagccccggtacgggagaaccccaggattgacacctcctaggatggagacaccactaaaatgaagactctccaactgcggatactctaggatggggagttacaaggatccctaaaattcaaagcctcagctgggaaatcttcaggacaggactttcagagtgaagacaccacgggatgggaatcccagtaagaggctctctaggatagaagccctctggacatgaaccctaaaaatggcttcctctaggatgaggacgctaccccagaagggacctccagaatggtgactcccaaaataaaatctccagtgggacaccccgagatggagaccacccaaggatggagaaaccccaaggagagagaccctccgcacaaagagctctggctgcagaccccaggatggggactcctcagggtaaacaccccttcagaatgggttttccccaaaggtggacacctggacacccccgagataggaccctcccaatggggttcccagaacagatgccccacccactgtggcaggagactcacccatgcagctgggggtttcaccgttccaggatggccgggtgccattgaggcagatgagggtctcctctccctgcagctggtagcccgaatcacagtgaaaggtggcagtgcccccagggtgcaggtccgtcacactcacgtccccatgggccggccggggagggaagccacagctcaggaggtaggctgcaccagacagacagcgggtagcagggctcactttcccatgccaccctctcatactgatcccccagcacttcccccctctcctttcaggccaaccttccaggggcacacactggctccatactggcgtacataccgagaaataagagctcctcacacaggcaccttgcctcgcgaacaggaaactccaacaccccttatctcccccactcattgtaattcaccctcgttggcccccattttatagatgaggtatctgaggttcaaacaagttattctggaccccgctactcatttgttgtgtgacttcaggcaaatcaatgaactactctgaacttcatccagctgtaataacagtatttgcagagcttgttcagctcccaaagtgagtccacacagagattttgaggtcagcagacaaagattatgtgacctggctaggcatgctggctcacgcctgtaatcccagcacttttggaggccgaggcaggtggatcacgaagtcaggagttcgagaccagcctggccaacatggtaaaaccccgtctctaaaaaatacgaaaattagccaggcgtggtggtgggtgcctgtaatcccagctacttggtaggctgaggcaggagaatcacttgaacccaggaggcagaggttgcagtgagccgagatcgtcccattgcactccagcctgggcgacaagagcaaaactctgtctcaaaaaaaaaaagattatgtgacctgttttgcaggtgtgaacactgaggctccaagttattaaatgtctcttttgatttttcttccctccacacacacagcctttcttccaccaaggtgccctgtggtataccctcagctcctcagcttccatccagaagaaccacttgaaacttctttttttttttttttttttttttttttttttgagatagggtctcactgtgttgcccaggctggagtgcagtggtgtgatcatagctcactggaaccttgaactcctggcctcaagcaatcctcctgacccagcctcccaagtagctgggactacaggtttgtgccaccatgccccgctaatttttaaattttttgtagagatgacatctcagtatgttgcccaggctggtcttgaactcctggcctcaagcaaacatgaaacttgttgaggaaatttgactattttgtctttttgtttttgtttttgtttttgaggagaagtctcactctgttgcccaggctggagtgcattggcgcaatctcggctcactgcaacctccgtctcccgggttcaagcggttctcctgcctcagcctcccaagtagctgggattacaggtgtgtgcgaccatgcctagctaatttttgtatttttagtagagatgggattttaccatgttggccagggtggtctcgaactcctgatctcttcagacctcctgacttcactttcactgggggattcatttacaggccactgagtattaagatctttaaagacaaaatagtctttaaaggcacagtggctcacgcctgtaatcctggcactttgggaggctgaggcgggcggatcacctgaggtcaggaaaaagacccaggccttgtcctcaggagtccattgtctactgagatgaacataagaacaaccttctagaacaaagtggtttcaataaatggtagctttgggaatggctgcccatgcccaacagaatcaagtctgaatgctttagtttgacattcaagccccttccatagttaaatgcagcccagcacattccaggttcagggttgatctcccaagaccgatatagcctacacaacacagttttgtgactccttaattttccacctccatattttcgcttgtgctctccccctactttctcatcttttaagagatcagactggggggcttatgtaccacctcttccaggaagccttcctgactctacatctctccaacagttacttgttctcttacctgtacacagtcctgcatgcatgattttgtcatcacattaaccattgtctttttttttttttttttttttttttgagagggtctcactctgtcacccagtctggagtgcagtggcttgatctcagctcattgcaacttttacctcccgggttcaagtaattctcctccctcagcctcccaagtagctgggattataggcgtgtgccacgactcctggctaattttggtatttttattattatttattttattattattattttttgagacggagtattgctctgtcacccaggctggagtgcagtgacacgatcttggctcactgcaacctccgtctcccaggttcaagcaattctccggcctcagcctcctgagtagctgggattacaggcatgtgccaccatgcccagctaatttctgtatttttagtagagacggtgtttcaccatgttggtcaggctggtctcgaactcctgacctcgtgatctgcccgcctcggcctcccaaagtgctgtgattacaggcgtgaaccactgtgctggtattttcagtacagacagtgtttcactatgttggccaggctggtcttgaactcctgacctcaggtgatccacctaccttggcctcccaaagtgctgggattacaggcgtgagccaccatacctggcctaaccactgtctacactggcccaagccttatttattttgtgtcctaaaaggctagtctatgaggtcaggagttccagaccagcctggccaatatggtgaaaccctgtctctaataaaaatacaaaaaattagctgggcatggtggcacacgcctataatcccagctactcaggaggctgagacaggagaatcgcttgaaccaagggggcggaggttgcagggagctgagattgtgccattgcactccagcctgggcagcagagtgagactccgtctcaaaaaaaaaaaagggctagcctggctgatcaatgggtgcagccaagaggcagcatggatcggtgcaaagaccactggatttgtcatcaggcagacctgagttccagttctagctccagaacttactaactacatgcctttgagcaggtgacttcatctctaggggcctctcacctattaacggcaataataattcctatcagggaagattggcctgaaaattaaataaaagaaacacgcaaagcacctggcacatagaagctgctgagaaaacgttaatcacccacccctcagcctcaattaatgaatgactgggagccagggactcggggatctgttgtctggctgcaataaacgtgcagatggttgagcaatctacataacctttgagtcttttccttcctttgagagatagaactgacaatggccactctcagggtttctgtgagaagcaaatgaaactaaggttggtgaaagggctttgtaatgggaaagtttgctgaacttggggtgaggggtgaaggagactttggcttttcagagaaactaatgaggccactctggaccagaggccccagctagtgcaggttgggaagggctgaaacagggccttggtcccaaaggtacccagtgcagctgcgaagcagggaagactgagcaatgaaggccaatttgtgcaatagtcctgcttccccaaatgttccacttagcctaaggagtcctattttcagtgccctggggaagtggctgcttaaaggagccagtggggagccatatcttcagatttcacaatatctgaaatccagcacttggcccaggccctccaggaatgctcttgctccccaataaccaggtccctactgccaaatacacgtcccccagcttgctggcccccgatgaataggcacctttgctatgcacacatgagcccctaaggcaggtcctgagcagaggcctcaaaagaggctggagaggacatgagaataggattcagggtgtaccctgcatgaggcacacaaggcatctgcggtcagcagagctttcaaggagggcagagtgcgtgacaccagccaaggccatgcggtgatgtgaagggggcattggcccgacacacagttctctctgtctccatgaagcataggaagacagtggggtctggaacagggcactggctgggcccctttcctcatgcacacatgtctgctagaacacacccttgtactgtgggaaggttcccgcacacacaggtaagcatggatgtacacacatgtgcaggtcatctgtcataggtcctaacaaatgcagtcgtgcgtgaatacagcccccctttcctgcccccagaagtcagaaggatctttaaattgcaaatctgaggctttcactttcctgcttaaaacatttcaggccaggcaccatggctcacgcctgtaatctcagcactttgggaggtcaaggcaggaggatttcctgaggtcgggagttcgagaccagcctgaccaacatggagaaaccccgtctctactaaaaatacaaagttagccgggagtggtggggcatgcttgtaatcccagctactcaggaggctgaggcaggagaatcgcttgaacccgggaggcagaggctgcggtgagccaagattgcgccattgcattccagcctggccaacaagagcaaaactccatctcaaataaataaataaataaataaataaaattcaaattaggaggcctggcgtggtggctcatgcctgtaatcccagcactttgggaggccaaggcgggtggatcacttgaggtcaggagttcgagaccagcctggccaacatggtgaaaccccatctctactaaaaatacaaaaattagccaggcgtagtggcaggtgcctgtaatcccagatactggggaggctgagacaggagaatcatctgaagctaggaggcagaggttgcagtgagctgaggtcatcaccactgcactccagcctgggcaacaaagtgagactctgtctcaaaaaaaaaaaaaaaaaaattcaaatatctgcctgtcacacctgcaggttgaagtagtctggactgcttactgaagcagataaggctctttatggtctgaatctgacctgcctcccagcctggtctctggcccatttccccttcacccgcttctgtgctttgaaagtaatagcagtgactgacagttttgagctctcactgtgtaccacacgctgtttgtgtttttgtttgtttgtttttgagacagagtttcacttttgtcacctagcctggagtacaatggcgcaatctcagctcaatgcaacctccgcctcctgggttcaaacaattctcttgcctcagcctcccaagtaactgggattacaggtgcttgccaccatgcctggctaatttttgtaattttagtagagatggggtttcaccatgttggccaggcaggtcttgaactcctgacctcaggtgatccaccagccttggcctcccaaagtgctgagattataggcgtgagccaccacgccaggccacacactgttttaaacacttgacatgtattaattcatttgatcttccccataatactaagtattgtgatccctatttttcagatgagatcatgaggcacagaaaagttaagtaacttgtcccaggtcacacagctaggacaattctatcttccatgctgaattccttcacctcatctgggggtcatgtcttctctctctgggtcttggagtgtgctttttcatccacttagccatctgcctccctccttctctccctccctcccaccctttccctggcgaatttatccttcaggtctcagcttagtcatcatctcctccaagaagatgtccccatattccttgggagaaatttaggtcccttggctatgtgctgcccccgctggtgtttctgccatcatattccttatctccttgaattataaccatcctgattactcatctgtcttcctacctagattctgagctcgttgaagccagatttacacctggtttgttcattcctccttcaaggctaacacagggcctggtatgaagcaagcacttgataaacatttgttggattcaatggatgaattgtccctcggatgtgtgcacagatctgtgagtgtgtgagataagtatgcatgggtctcctctgagggccctgccccccagggtcgcagtcaggaggaaaagcccccttcggcaccctgtgcttcgatggttcttaaagatgtcccctctataggccgggcacagtggctcttgcctgtaatcccagcactttgggaggctgaggcaggtggatcacaaagtcaggagatcgagaccatcctggctaacgcggtgaaatcccatctctactaaaaatacaaaaaattagctgggcatggtggcgggcgtctgtagtcccagctacttgagaggctgaggcaggagaatggcgtgaacctgggaggcagagcttgcagtgagctgagatcacgccactgacctccagtctgggcgacagagcaagactctgtctcaaaaaaaaaaaaaaaaaaaaagatgtccagtgtatgcagtatggcccctgcccttccagcagcaccctcaaactcctcaccctgatagtggatcctgaagccaccgccccttgggacccgtgggctctggaagtgcagaagcagccggttggttgggctccgaaggacttgtccttctccaagcatggatgagttggccaggagtcggggggccaggcctggggatcccccaccagccagcaccaggagctcctcttcctgtgacaggttcagcgtctgcacctagagaagccagacacagacccgccagggcaagtcagccaggtgtttgacttccaaagcccctgtcctgtgcctttgccctgtgtgtagcagcccaaaaggcaccacgctgctgcccaagttgtagaaatctagaagagtttttgaggtcacctgagtcatcagacaggttctttggctcccaggccaaacccgtgcacacccacagcccagaggaaaaggcttggaagctgcacagtcacatgctttggtccagttacctggatctcaatgccgtagccagggtagacatggatgctgtaagtgcagtccaggagccccagggtgcggctgacggggctccccagatctggagactccacatacccttcgccctcggagatgttgttattacacagaactgaggagatacaaatggctgggatggaaggaatgcctgtgcttttgccctcccagccaagcaactctggccttcatctcccttctccttagcacttctcatcatctttttgttttgtttgagacagggtctcgctctgtcacccaggctggagtgcagtggtgcaatcatggctcactgcagtctcaaattcctgggctcaagtgatcctccctcctcagcctcccgagtagctgggcccacaggtgcacatcaccatggtgagacaatttttaaaactttttgtagaaatggggtcttgccacatttcccaggctggactcaaactcctggcctcaagcgatcctcctgccttggcctcccaaatcactgggattacagctgtgcgctgctgtgcccccctcaccatcttttatttttttatttttatttttttaagatggagttttgctcttgttgcctaggctagagtgcaatggctggatctcagctcaccacaacctccacctcccgggttcaagcaattctcctgcctcagccttctgagtagctgggattacaggcatgcgccaccacgcctggctaattttgtatttttagtagagacagggtttctccatgttgctcaggctggtctcgaactcccgacctcaggtgatctgcccgcctggcctcccaaagtgctgggattacaggctagagccaccatgtccatcactatctttaagcaatgctccctctcccacctgagccagaactccctttcccaactgttatatagctgaaacaattggaacactgcctggtacatagtaagggtacagaaatgctacctttgttattattattctcccatctgtacccaggactccttccacagttcccagcagcctctctcccatccatccccagcgtgtacctctccggtcctcccacccccatccccttgctgtcgcctcacctgggctggtcaccgtagtggtaacagttgtcgtggtgatgatggtggtcgtcgtctcctcctctcctccctcaggcccaaggggaggccctggggaggcagggctgggtgggggtggggctgtggttcctgggggcggggtcagcagttctggcgcagtggggcctgcccccctgaccccgttaggggtgacggctgttgtcagaggccctgtccccggctcagtggcccgtggcagggagggcactgcgagagtctggccggccggaggggtggctagcgtggggtcccgatcagatcctgggacagtgcagggaatatcagagcacaggaggagcacatggaggaccttgggtggggagcagggctgagggaagctaggggttcccctgccataccacaaaagcctcccgcacaaggtacagcaccccccacctttcccttccccaccccagcccctacctcctcccaaggcttccacagcctgagtcccccctctttctcttctggtcccttctctccacccagccccttccaccctgatactcctctccctgagcctctctctctgcctcctcactcagatcacgttctctctctggttatctcctctctcctctgtctcattctctctcgaactctttatttccccatttccctgtttagtattctgattgcactctgatttcatgattcgagatccactagtttttgtgtttcattctctctgtctctgtcttccaccatttctctgagtctggttctctgaatttccatctctgtttctatgtgtctgtttttctgtctgactgtcacctaatcattctgtctctgtctctctggttctgtctgtgcccaggtttgactttctctgacagtctcgttctgtgttccctgaatctcacaggaatgcaggctctttcctctgcagtctctctctgcctgctcttctctagcctggctccccatctccctgagcccatatccctccctctgcctctaggccactcctgccactctgggggcctcacctggcaggtagcccatctctgggcccctcctcagcagggccccatgaagcagttcagccagggcctcagaggccaccgtgggggtctcacttccaggctctggcaatatctcctcctccttcaggggcagacctaggaggtgaagttgtgtgagcttctccacttccccacaccccttccttctccagagagatattttctagaactcttcctccctcctccatcagctgggcctgcaggggctcagatggtcccaggctcgactgagggccaagatcggaggaggggctcccagctgccctcatactcccactcccacacctcttctctcccctcccctctcccttctccctgggctgtgtgggccttcattgaacaccttagctcttatggaccctggacagcgccagcaaggcagaggggtcgccggtgctgccttccctttcacctcagtggtgatctccccccaaccctggggctctgcagaggatctggccgcacctcccagcccttgcttccgcagtgcctggctttctctctgggtttctgtctctgcagtgtggctgtcttttctctctctctctctctctctctcccccccaccctctctctctctggtcctctgcagtctctgcctccttccctggagtctggctgggggtcagagtgggggactgaaaatctggtctttgagccctgcctctgctcatctgtctttgtccattcatccaagaacagttgtgtgtacagcgcctggcatctctctcagcacctccatctcccacccaggtccctccatgcttctgccgcctccgcagacatccccccaactttcccagccctccttcttggatctagcccctgagacactgctaaaagcttctctcattcatttctctgccttctcaatattgagggttaaggggcttcgggttcaagcctgaaagctctggcttgccccttccccatcagctgtgcctctcccctcccccatgtgctcggaagacccaggatattaagagaaaggagggtggaggaccccgctggacgccttcctggggcccacccccacagtctcatgtccttaccctggatccagggacagctcagcagaattaggaacagcagctggggaggcggcgggtgctgggccctgggagtccccatggcgactcaccccgatctctctcctctgtgcctctctaagtaatctggctgccacctttcctccgtctccgtttatctttccctttaattgttttttttttttttttttttttcctcgtaggagtcagcaaagaaagacaatttctctgccccttgggatggaggggcagaattgggctaggggtcgcctggagcccacccccctttgctcagtctcctctgtcctcttctcgcggctctgtggtggagggggcgcggctccggctgcagggggtggggccgagagggccgaaggggccgggtggcctgggttaccctcctgctcaggcgcctgggtccactgggctgtctggaccccaagctaggggactggggaggagaaagacagcttctgggggtttagggtggggtcgaggatcgagggggtctccactgggctctagcggggcttgtcggggaggggaaggggtgggttggggaactgggagagccgaagctcgggcactggagctgcgggagggagaagctgagaaaggtatcgagcccacgtcagatcctggggacgggcggagggaggggcctgggatttatttgacggggagggaggaggaggaagtgcagatggaggagggagggatcatacgagccagggccgtaatcctcactcccgcggcccctaggggaggcaaaggaaactctctggtcccagcagtaattagccccctccgcctgccattccagcacatctggaatctgaatctcctcttcccagggtgccgaggggctgcatagcttggttcgcgcctgctaggcccccaattatgccccctgttcacattcagacctcccaaggggcttcccttccccttttacagtagctcgggtggaatgggctctccctcctccaggggaatagagagcttccacgattgtgacaagtctcgtgggtgacgggccggggtttggggaggagagacagacccctcctcttccataaaccctgaccccggccagctaacaggcggcctcggctctgattttccctccggagcgcccttttcagcaccagcggcgcgcggacagctcccctcgccccgccggggcgggcccggcccgacgccgcccgcgattggctgaggccgctttcggtgtttgccaggctcgcgggctcccgggctgcctagggccagcgggagtcacaggccgaccgaccgacggaccagccgcccgacggactggcctcagcatccttgcccgcagtcccgggcgcctgcccagccgtcagtccgcgctcgccccgcccctcaggccccgcccctcaggccccgcccgatacgacccgccccttctttcgcattgcgggacggctggaggctggcaccgtggcccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcagggtgagtgggagcccaggaaggagcgagtaggagagagggagcgagagccaggcaggaccgcagggtcggggctagtgaggagcgagggcaaggagagagcagtgaggccggagagaaagaagctgccgcggaggaagacaggctgcgggttcccgggactgcaggtccaggcagggtaggaaccgctgcccaggggagctaggaggaagcggggagagagagcgagcgaaaagcgggggtggggaggaaagggggagattgaggtgggagagagaagcagagcgagagagaggaggctgctggaaggagaaagaagagggtgaggaggcgacagagggagaggaggaagaagaggtagaaggagagagaaaggggagagaaaggagagaggagggttggaggtgcatgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggtaagtagctgccgcctactgacaacctccttgcctcgatgatttcccccccagacccttctctccgccagagccgtctgctgtctggttctcattgtgcctctcttcttccatggctccctgttgccacccacagcagcatttcctcagcctcggttatctgcacaccaccttcataagctttgccgtggtcattcccatctgtactgcgtttcttcaccttggctctccccccgaccttttgttctacgtatttaaaagaaatatttatagcactatcagtattacttgccctaaatagtactcataaaaagcctggacaacacagtgagaccttgtctctacaaataataaaacaattagccgggcgcggtggcccatgcctatggtcccagctactggagagggtgaggtgggaggttcactggagctcagcagtttgaggctgcagtgagctgagattgtgctactgcactccagcctgggtgacaagaaagtactcataaacacaagctgaaatttaaaaaagaaagctttcaacagtctagaacattctagttaagtgctctagtctctctgatcctgaagcctacacttttttcttttttgaggagtctcgctctgtcgcccaggcgagagtgcagtggcacgatcttggctcactgcaagctccacctcccgggttcataccattctcctgcctcagcctcccgagtatctgggactacaggcacctgccactacacctggctaatttttttttattttgtatttttagtgaagacagggtttcaccatgttagccaggatggtctccatctcctgacctcgtgatcaatccgcctcggcctcccaaagtgctgggattacaggcatgagccaccgtgcctagccctacaccttcttttttaaaagggttggtggggtgtcaaagttacagtagcaccaaactgagattttttctttttcttttttttttttttttgagacagggtctcactctgtcacccaggctggagtgcagtggcacaaacatggctcactacagccttaacctcctgagatcaaaggatcctctcacctcagcctcctgagtagctgggaccacaggtgcccaccaccatgcttggctgattttttaaaaatttacgtaggccaggcgcggtggctcacgcctgtaatcccagcactttgggaggctgaggcaggcggatcacctgaggctgggagttcgagaccagctgaccaacatggagaaatcctgtctctactaaaattacagaaaattagctgggtgtggtgtcgcatgcctgtaatcccagctactcgggaggccgaggcaggagaatcacttgaactcgggaggcggaggttgcagtgagccgagatcacaacattgcactccagcctgggcaacaagagcgaaacttcatctcaaaaacaagaaaaaaaaattgtgtaaagacaggctggacctgaactcctgaactcaagtgatcctcctgccttggcctcccaaagtgctgagattacaggcgtgagccaccgcacctggcactttttgatgtcttaaagactggaagaaaatggaaaaggaaataattttctgttattccatgccatgaccttgttttgcccccaatcatctcctgtgctgccagctggatgtgtcctacacttcagggcacactagcctcaggatcagttcccaatccttcctctcttccctctctctgtgctctaaatcatgaaaaccttctggccaatcctgacagatgccacatgtgctgttcttttcaacctagaatccccttcccccgtaccacctcctgaaaaactcctactcagccttcagtactcaagttttcaagtgccacacttcctctgggttggcttcctgttcccccatcagttgagttggctgctcactttcctcacagcactcagccatgtggtccttgggccaggaacgtctttaatcttatacctctcagtgagacagcgcctatcacacagtaagctcttgagtcaaactgtcgaaagcccaggaggaaaagccatttcctccaggaagccttctcttttctcgaaatgagaggttgctgccaggtgccgtggctcatccctgaaataccagcactttgggaggccaaagcaggaggattgcttgaggccaggagttcaagaccagcactgtctgtataagaataaaataaaataaaataaaataaaataacgggtctggccaggtgcagtggctcacacctgtaatcccagcattttgggaggctgaggtaggcagatcacttgagctcaggggttcgagaccagcctggccaacatggcgaaaccccatctctactaaaaatacaaaaattagccaggcgtggtggcaggcagctgtaatcctagctactcgggaggctgaggcaggagaattgcttgaacctgggaggcggaggttgcagtgagccaagatcatgccactgcactccaacctggcgacagagcaagactacatctcaaaaaaaaaaacaaaacaaaaaattaaccctgcattgtagcacatgcctgtaatcccagcagctactcaggaggctgagacacgagaatcacttgaacctgggaagcagagtgagctgagatcacaccactccactccagcctgggtgagagagtgagactttgtctcaaaaaaaaaaaaaaaaaaaagatgggtcacactacccacagcagcgtttccctaatctcctagcacttccctcctccaggactgtattgtaattatactgtggccactttctggaaagaaaggaggatgaccacaaaacctggcatttaagacacttagagctagttgctaattgactggccaggatgggcccctgggatggaggcaggagtgctggatgcccgcgtctcttcttacaggcctaaagatccctcctggctgtgagctggtggtcggcggtgagccccagtgctgggctgaggggcactgtctactggtggacgactcttttctacacacagtggctcacaatggtaacggggtgcccattctgcaggggggatgagggactcaggagcaaaggagcgttgactagaaggcagcagaatcaggcccaacggacttcctgtcctaccaccaccatcttccagctgcatgaccttgaacaagccgcataacttctccaatgccctaggaccaccaccttcttcatcaagtaactgcaaggattaaatgagataatattacgtacacagaaaagcggttaccagcacaggactctgggttcctgtcctacctcttgcacttgggcaaaggacttaacctccttatgcctctgttgctttgtataaaatagggataattatggtaataccacagtttgttttgatgattaagagttgatacatatcggccgggcatggtggctcacgcctgtaatcccagcactttgggaggctgaggtgggcggatcacctgaggccaggagttcgagaccagcctggccaacatggtgaaaccccgtctctattaaacatacaaagaaattacccaggtgtggtgatgagcacctgaaatcccagctactagggagactgaggcaggagaattgcttgaacctgggaggccaaggttgcagtgagccgaaattgcgccactgcactccagcctggtgacagagcaagactccatctcaggaaaaaaaaaaaaaaaaaaaaaaaagatttgatacatttaaagggttagaacaaggcctgccacttatttactgtttgcttttatggtgtttggtgagtgctctggtgtgcaagtacctaatgtcagtggctctgctgttcctgtcccatgtgccctaggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatggtagccaggacctcctctctactgcgggggtgggcgggggcggaggatgggaactggctagtgagcactgaaatataaattctgaatcctctcctaactcccgactacttccttcgcagggagaggctggggcagggccttatgtcttctcctagtacaaccaaacaggtacctccttttttttctttcttttttttttttttttgtagagtcagggtcttgctttgttgcccaggctggtcttgaactcctgggctcaagtgatccttctgcctcaacctcctgagtagttgggattacacgtgtgagccaccacgcccggccagatacctcctaacacaggcatctccccgtccctctccccaggagccagcaccagtttctcaacttaactttatttcaataatttaatagaaaattaaaataataaataatatgaaacagactgataacgctgagctgggcaggcccaggccagtctagtacaaagttaaggaggtagggaggatggtggggaggagggggcggactaccctgcaggacgcgggaggctgctcagactgtggtgatgtcaggaagggccgcacactttggcatggacgatgcactaaaaaaagagaaagggaattctaaatccctcttaaccagctggagagggaaggacgcagggccagggtggggacaagtgttggcttcggaaggctctgagtggtggggccggaatgtaccatgttgttagcaatggggttgggatgggtggagaagggccaaagtgagctgtgccatgcaatgaagggacagaggaggacccacgacttggccagcagagccggggcaaaagtctgggaaggggagggaaagagagagggactgggtcccaaggcaagaggaaggcagggggagggtcagaggtcagtccttgaagacaatttgttggccatgaggacgctcgtcgtgggtgatatggcgccggacatggatcctgcggacacggtgctctcggttctcttcatcctccccgcggccagccccaccagctccagctgctccccctgtggcctccaggagggctgggtctgggccccggggagtctcgtagatgaggatgttcagggtctcctcgaagatccgggcctctggaaattccacctgcaaaaggccagccggccccagctccttccttctggtgcagtcacgcagggccatccccctgcctagggcccctgcaccaacacacctcctagccctgcagtcaggtccttgggcctggcctggcctctctgccactcctttactcagcaaagtcatacttcaaggctcagctctgaagtcaggcaggcagaattatttgttttctctccttcatctccttccctgcctagcctcttggtatattttttcatttgacaaatactgagtgagtgcactgcaccaggtattgttctaggcactgcaaaaatagcagtgaacaaaacaagagttctgtcctcaggaggttacattctagtgggaggactcagtcatacacttaagaaaatataaactagcctggcgcagtgactcaggcctgtaatcccagcactttgggaggccaaggtgggaggacagcttgaggccaggagtttgagtctagtctgggcaacatggtgtaaccccatctctaccaaaaatacaaaaaattagctaggtgtggtggcccacacctgtgttcccagctactcgggagactgaggtgggaggatcacctgagcatgggaggtggaggttgcagtgagccaagattgtaccactgcactccaacctgggtgacagtgagaccccatctcaaaataaataaataaataaataaaataaaatataaatgcagtcaaatgatgatgtttaggaaacgatataagctgggtgtggtgtctcctgactgtaatcccagcacattgggaggctaaggcaggaacatcgttagagcccaggagttcaagttcaaagccagcctgggcaatgtagcaagacctcatctattaaaaaaaaaaaaagagagagagagagaaagagatacatcaggaaaagagatacatcaggaaaaggggatgtgatagccagagccaggagtgttacaactttaagaaggactccagggaaggcctcactgagaaggtgatatttgaccaaaggagtgggggaggggacaaggcacacagagcagaaagagcagcctggggagggccagggccagcgtgagagctgtgggtcaggagtgcacccagtgtcttactggaagatcaaaagggaggccaatgcaattgaggcagagatgagagggaatggaaagggatgaagtcgaagaggtgactggggtgttcccttgtgtggccttggaagcatctaacacagctcttagcaaactgtttttttaattttttatttttattttttattttttcctgagacagagtcttgctctgtcacccaggctggagcgcaatggcacaatctcagctcactgcaacctccacttcccaagttcaagcgattttcctgcttcaacctcccggagtagctgggattacaggcatgtgccattatgcccagctaatttttggatttttagtagagacagggtttcaccatgttgtacaggctggtctcgaactcctgacctcgtgatctgcccgcctcagcctcccaaagtgctgggattacaggtgtgagccaccatgcccggccttttttttttttttttaatcgttgtttgtttgtttctaagacaagatctcactctgttgcctaggctggagtgcagtggtgtgatcatgtatccctgcagcctcaacctcccgggctcaagtgatcctcccacctcagcttcctgagtacctgggtgtaccactatgtccagttaatttttttttattttttgtagagatggggtcttgctgtgttgcccaggctggcctcaaactcctggccttaatggtcccctgcctcagcctcctaaagtattgggattacaggtgtgagccatgcactctaattattggtttatcttcctatcttcccaatcagaggatgtttcttggaagctgggtcactgattcattcattcattcattcaataaatgtttcctagcttccactgtgtgaaaagggcccagctaatgggagataggaaagaaaaagacatggccctgccctcaaggaactaacacctcgctgctgatgcaaaccccctcccctccaccacacatgataaaacactgtctttagctatgaagggagtgtgaccaactttggggttgctggattgaaagttcatgagtgaaggtgacccaaagaaagtgatgcttagcttgagtcttaagattaagtacaagttcattaggcagatagaaggaaagaattccaagaggcaacagtgtgtgcagaggtaagaggtaagaaatagcactgagtgcttagagacttgtgatgactgtggtgtacctgaggcatgtggctcatagtaagctcggaagggaccagatgaggaagggcttgtattttgctcagcacttcattccccttgatttccagcccggtacagtacttagcacagagcaggggcttggggaatatcttgatgattgccacattaatgactcaggatctacaaactcagaggatgttctaagagacatctgattctgaggttttaagaatctatttttggcaatgggcctttctgagtttcccttttttttttttttaattagagttagggctcactctgtctcctaggatggagtgcagtggcatgatcatagctccctgctgcctcaaattcctgggctagggcgggcccggtggctcacacctataatccaagcactttgggaggccgaggagggcagatcacttgaggtcaggggttcaataccagcctgaccaacatggcgaagtctctactaaagagacttctctactacatttagtctctactaaaaaatacaaaaattagccgggcatggaggcgggtgcctgtagtgccagctacttgggaggctgaggcaggagaatcacttgaatctgggaggcagaggttaagtgagctgagatcacaccattgcactgcagcttgggcaacagagtgagactctgtctaaaaaaaaaaaaaaaaaaataggctgggggcagtggctcacgcttgtaatcccagcactttgggaggctgaggtgggtggatcacgaggtcaagagattgagaccatcctggccaacatggtgaaaccccgtttctactaaaaatacaaaaattagctgggcatggtggcacgtgcctgtagtcctagctactggggaggctgaggcagaagaatcgcttgaacctgggaggtagaggttgcggtgagcggagattgtgccactgcactacagcctggtgacacaacgagactccatctcaaataataataataataataataaataaataaattactgggctcaagcaatcctcctgccttagcttcctgagtagctgggattacaggtgcatgccatcatgtcaccaagccaccacacctggctaaattttttgacttcttacagagatcaggtcccacgatgttgcccaggctggtctcgaactcctgggctcaagtgatcctcctgccttggcctcccagagtcctggggttacaggcgtaagccactatgcctcaccccttctgagtttctaatggcaactatggaccccctatacagaaaaatgcatacacccccatttcaggagttgcaaacagccttgaaacccatccaacaggcctaggctaagcaccctgctctaacccgtgacccccatttcacagagaaacagagacccacagggatagggtggcttgcccactgttgtgcaccccagaccccaggatctggctcctgcctcctggtggtgggctccttcccctgccaacctgcttttgtccagggtcctggtcctggccacccccagcccccaacataggctctggagcccctctgaccttggtctgcttcttctccgtagcatagacaatggaggtgcagcacacctcggcgattttgcggccctgcccgtagaaagaccagcagcagatctcgtcccccaggacatccttgaggaagagtagccgcccgtggaagcgcagggccagcttgtcgaacagctcgatgttcttaagtaggttgtcatctgaagtgctggggaccaggggaccaggaggcctcagcgcagttggcacccctccctctgtacccccagaagacgggcctggatgcattcccagtcctctgctcctgcccagggctttggtgctcaacagagagcctcctccacccctggggccaggctaaacgggtctcagaagggaagccacatgcgctgagcaaatcccagcacagcacagcacagcagctccagtgagggaccgggagccaggccacctccccgggggtcctggtgtccccattttttaactgggtgacactaggcaagttacttcacctcttggtgtcccgacctcctcatctgtaaaatggagctcacaacagtactgacctcaagggggaggactctgccagttcctagaatgagagcacttgggataggctcgccactatcactttgtcctcacccaaacccatttactgatgactgagctgaagctgagaagcagaaaggacctgcctagagcgtcaggggtaagaggcgaagccgaatctgcgagcaggcacagatgttcttgtaggccccccgtgtggccgtggccctcgccttgggcagaagcagggctgtgctgcatcccagggtcccgcccagtgccccgcaccccggcggtcacctggtgtaggagtacttgttgttactgcggttgtgcaggagcttcaccacgggctggcgggggagagaggatggacgagaggggtgaggctgcagggagaggcccccccagtgagcctccaccctgcagggcttgggggcctcaccttggaggtgctggccaggagctgctgctcctcccggggagatgtcaccatggggatgaggcacagcggggacagcgtctcccttttttgctggggaagaagcggaaggtggttaacagcacaaccaaaggccacgtactcccccacttaaaagccttcaaaagctggttgggaacaactccagactcctcagtggtccgcagggctctgcaggctccaagctccgccagcctctctgccactctccctttgcttgctgggccttggtcccacggacaccttgctgcttcacacatccagcttgtgcctgccccggccactggctgtgcccctgcccgggatgcttctttgctcagctgtcagcgtggcgtgtccgtcatgccattcagatcgcaggtcacacagtgcctcctcagggccagccctccccagcccccctggctaaaacagcctcctctacatcctgccttttgtgttatcagttttctttttctttttttgagacagagtttcgcttgttgcccaggctggagtgcaatggcgccatctcggctcactgcaacctccacctcccgggttaaagcaattctcctgcctcagcctcctgagtagctgggattacaggcatgtgccaccacacccagctaattttgtatttttagtagagacgaggtttctccatgttggtcaggctggtcatgaactcccgaactcaggtgatcagcccgcctcagcctcccaaagtgctgggattacaggcgtgagccactgcaccaggcctatcagttcattttctacacagcagttagtgtctgactttttctaactttttgtatttgtttatgatctgtctcttcccacctaggaataactacctagtatacagctgatgctctgtatttgttgaatgaatgaacatatttgttgagtgaatgaacttcattgggtgggatgacgttggagaaagaaatctgaagcaaacccatgggcttctttctcttctgtcttctagaatcttcatgccaaaatccctctcacttctcccaaccttgaaaactcaatgcgcaattctaatacaaattccagatttgttttttgcagaaactcataagactctctaaaattaacagagaataataaaagtctacaattactgaggccattttttttttttttttttttttgagacagggtcttgctgtcatccaggctgagtgcagtggcatgaccacagcttacagcagccttgacctcctgggctcaagccatcctcccaaacttaggtcagtttttaaaaataagagcaaagaggaaaggccgaccctgccagatattaagataggctgcaaagccacaacagtgagaacggtatcagttcgggcacagaaacaaaaatacctgagaaacacaacagagcgatcagaaacagaccactgtgtatatgagaattggtatttttaaaaagacaccacaaatgtgcgaggggaattacggagtatgaattcgttatctatcactgtgtaacaaactgcccccaatttaggagcttaaattaacaatatttattacttctgtttctgagggtcaggatctcagcagtggctcggctgggtggctccggcacagggtctcttctgaggctgtggccaagatgtcagtggggctgtgggcatcaaaggcatgaccgcccctagaggatgcactctgagaaagcttgttcatgtggctggcaagttcgcactagctgctggcaggaaacaacaaatccctgccatgtagatctctccacagggttgcttgagtatcctcgcagcatggcaactggcttctccagagcaaataattccagagagggcaaggtggaagcctcattgtcttttttatttttgagatggagtctcactgtgtcgcccaggctggagtgcagtggcgtaatatcggctcactgcaacctccgcctcccaggttcaagtgattttcctgcctcaaccacccaagtagctgggattaccgaggtgtgccatcacgcccagctaatttttgtatttttagtagagacagggtttcaccatgttggccaggctggtctcaaactcccgacctcaggtgatccactcgcctcagcctcccaaagtgctgggattacagacgtgagccacagcgccgggcccctccattgtcttttatgacctaggtctgttggtcctatccagtgaggaaggagatgacacacaggaacgagcaccaggggacgagaatcatcaggctgccttggtggctggctccacaggccaccgctggctctcagtgatttcccccctcccacatgccaaatatactcaccaccttccaggatcccccatcatcccattacagcatcagctcaaagtacagaatctcatcatctcagtcaggtccaggtggggatgtggctctagcatgcagttccgtaactatggctccttaagtgcatttcttttttttttttttttttgaaatggagtcttgctctgtctcccaagctgaagtgcagagccaccaccatctcacctcactgaaaactctgcttcccaggttcaagtgattctcttgcctcagcatcccaagtagctgggactacaggcatgcaccaccatcccagctaattttctttagtagagacgggatttcaccatgttggccaggctcgtctttaactcctgacctcaggtgatccacttgccttggcctcccaaagtgttgggattacaggcgtgagccaccgcatccagcccttaagtgcatttcctatctgcagacctgtgagctaaagagacaggtcatctccacactcccagtgtgcagtggtagaggcaggcacaggataaccagtaaggacattcttgctcaaaagcaggggaagccgggcgtggtagcgtgtgcctgtcatcccagctactcaggaggccaaggtgggaggattacttgagcccaggagttcgagaccagcctgggcaacatagcaagactctgtctcaaaaaaaaaaaaaagtggggcaggggacaggaggcacatataagtcatacatataagtcactggtgtgtggaaattctgtaatccagttggagaaatgctaggaactctttgatgcctactcctgttcatgaatgattctccatggctctccctgagtcgtcccacctcttccatgaaagatgtttgcagctccacagtttcatctgcctgcttcctgcctgtaaaagtttgggtgtgcaaagccgtcttgtccttttgcactggctctgtccctttcagtccaagctggcagtgtctctgccaatataattctcttcataacttattgggtatcttgcatgtcttagggttcactacattagaaaaaagccacacctagaaatctctgcaagtggccaggcacagtggctcacgcctgtaatcccagcactttgggaggccgaggtgggtggatcacctgaggtcaggagtttgagactagcctgaccaacatggtgaaaccccatctctactaaaaatacaaaaattagctgggcgtggtggtgggcacctgtaatcgcagctactcaggaggctgagacaggagaatcacttgaacccaggaggaggaggttgcagtgagctatctcaaaaaaaaaaaaaagaaaagaaaaagaaaaaagaaaatctctgcaaggtaagcccttctctactttgggcttgtgctgagacgctgaaagacaacacctttaaccttctcagaagcgtgattattatttcattcgactggaagtcccctctgaggcatcttgttggtatttctgaggtcttaacaaaggactttttcatcacatcctcagcttgacctttagaccacatttccctgtatttaatgccttgtatttaatctttgcacggaagccatttgttaattttaacatcacttgttatctggaaaggctgggaattttcaaacccaacaatttcaggctctttttcatttaagtgttttttttctttaacttactctctcctcttcagttttactataagcagcaagaagccaggtggcaccttcaacattctgtctggaaagctccttagctagaccatccgttccttaggtatatttcctaccctccacactaatgcaggagacagtgttgctaaactttctgccgctacacaaggatctcctttccatcagtttccaatagcattttcctaactgttcttcaagcccttattgcagctgtcttaaaggtcactggactcttattaacagactttctcaccttttttcttttaatttttttagagacaaggtctcactatattgctcaggctggtctcgaactcctgaactcaagtgatcctcccaccttggcctccaaaagttatggtattacaagtgtgaaccactgtgcccagccaatactttttaacactccttaagcttttactaacaatctcctcaaagtccttccagcttcttcccacttctcagttgtaaagttacttctacatttgaggtttctgttatggcagacccccattccagaaaccaaagtctgttctctgttactgggtaacaaattactacaaactcagcagcttaaaacaacagtccaggtgtggaggctcatgcctgtaatctcagcattttgggaggccaaggctggaggactgcttgaggtcaggagttcgagaccagcctggccgacagagcaagactctgtctctatttaaaaataaataaataaaaataaacattatctcacatagtttctgtgggtcaggaatttgggatgggcttagctgggtggccctggcccagaatctgtcatgaagctgcagtctggattttggctagggctgcagtcatcagaaggtttgcctgggcctagaagctctggttctgagacaggtcaccactatggcggggagtctgtgcttgctgtcggcaggggcttcagttcctcaccaagtggacctctgcttagggatgcctgagtgtcctcacatagcattcacatagagtgagtgatctcaaagagaggcagaagctgtaatgtcttttatgacctagcttcaaagtcacatgctgtcatttctgcaatgtcctattggtcatacacaagggtctccttggtgaggatctgaaaaggtctgccctatttggtgtgggaggggactgaacaagagcctggaaaccaggaggcaagaacccctggtggctgtcttgggtgctggctacctctggactgtttaatacctggcactgggaaaactacctcaccctatggaagacaaaaatgagctaaatcccttcacaatcatatttacaaaagtgagttccatttagattaaaatacccatatatgaaaaaaatccatatttaaaactataggtcaggtatagcggatcacacctgtaatcccagcactttgggaggccgaagtgggcagatcgcttgagctcaggagtttgagaccagcttgaccaacatggcaaaaccccctttctacaaaaaatacaaaaattagacgggtgtggtggctcatgcttgtaatcccagcactttgggagaccaaggcgggcggatcacgaggtcaggagttcgagaccagtctggccaacgtcgtgaaaccccatctctgctaaaatacaaaaattagccaggcatggtggtgcacgcctgtaatcccagctactcaggaggttagggcaggagaatcgcttgaacccgggaggcagaggttgcagtgagccgagatcatgccactgcactccagtctgggcaatagagtgagactccatttagaaaaataaaaaataaaaaatcagccaggtgtcatggtgcacgcctgtaatcgcagctactcgggaggctgagacatgaaaattgtttgaacctgggaggtggaggttgcagtgagccgagatgacaccattgaactctaacctgggtgacagatcaagactctgcctcaaaaaataaaaataaaactacaaagctcacaggtaacagaaaatcagaaaaacatttttaaacaagaccataaggatacagcattaggcaaaaaatggtgaggaattggactacatccaaatcaagaatttttcaagttgacaatggaaagcatgactttacaaataatctcatgtaataatgttgaagagaaaagacttataggtattctgtggcacaaatgtaattactggttcaggtaaggattatcaatttgtgtgtcattgataggtaactgccttaatacagtggccaaataccatatgcattattttatagttagcaacaaggaaatgtaacaatgatagagaaatcaaaccaccatcccctagatccaggggccaattatgaacgtcattaatgacgagtcatattaacaatattatgggttgcttgatgtggcccaacgtgaaatacatacataatattacctaaaatgtattctaaacaaaatgtttaatatcagtcattttatttattttattatttattcatttattttgagacagagtcttgctctgttgaccaggctggagtgcagtggtgcaaccttgactcactgcaacctctgcctcccaggttcatataattcttctgcctcagcctcctgagtaactgggactacaggcacccaccaccactcccagctaatttttgtaattttttatttatttatttatttatttttgagatggagtctcgcactgttgcccaggctggagtgcagtggcacgatctcggctcactgcaacctctgcctccccaggttcaagcgattctcctgcctcagcctcctgagtagctgggattacagatgcccaccaccaggcctggctaatttttttgtatttttagtagatacagggtttcaccatgttggccaggctggtcttgaactcctgaccttgtgatccacctgcctcagcctcccaaagtgctgggattacaggcatgagccaccgcacctggcataatttttgtatttttaatagagatggggtttcaccatgctgaccaggctggtctcaaactcctgacctcaagtgatccacctgccttggcctcccaaagtgctgggattataggcgtgagccaccgtgcccacccaatatcagtcatttaaaatctacagtctggtttacaggaaattaaggataaggctgggtaataaaccaaacgataccgggagtaaacaaccaggcaaagttggaaagcgggtcattgtgcaggacaactggcagtctctttaacaagccagcatcgtgaggaaaaagggaccccttggattgtaataaagtaatgcttatggtattatttggcttatgtaataaagtaatgcttatggtattatttggcttatgtaataaagtaatgcttatggtattattatggtaactgtattaaggcagttacctatcaatgataatccttacctgaaccagtaattacattcgtgccatagaatacctataactcttatcatctcttcaacattattacatgaaactatttgtaaagtcatgctttccattgttaacttgcagataaccagatgcaacgtgaagatctagactggaccctggtttgatgaaccagctgtaaaaacacatttctggaacaactggagaaaccggagtatgccctggactggatattaaataaaaatttattgacatgtaaagatggcaattattaacaacaacaaaaaacagattataaaacatttcatacaacacgattgtattttggcaagcaaatacacacacacacacatactctcacacaggaaacgacctggaagaatatttggtgcttttattttttagattatttgtgtttctgaaatttctacaattaataaatactgctttaaaataatcaatggttatttgtaattttaaaaaatcaaggatttccattcaatgctagatgccacaagtgggtgacattctaagaaaaaatattggcgatatctacattgactagaaatttttatctagaacagactttttcaactgaagttcctcatctgaatctcaaaaaccagcaaatatggccaggcacggtggctcacgcctgaatcccagcactttgggaggccaaggcaggtggatcacttgaggtcaggagttcgagaccagcctggccaacatggcgaaactccatctctaccaaaaatatgataaaattagccaggcattgtagtgcacacatgtagtcccagctacccggaaagctgaggcaggagaatcacttgaaccccagagagggaggttgcagtgaggtaagatcgcgccactgcactccaccctgggcgacagagcaagactccacctcaaaaaaagaaaaacaaaaacaaaaacaaaaaaacagcaaataatttgagtgttttctgaactttgctgagaacagtaggtaaatagtcccatgctacaggcttagaggttaatttgttatgtatataatccatgccctagggaatgtataagacatacccatatgcagtagggcttaattatccctaggaactaaactaaaatatgcaaggatctcctgctaagcaacatgaaaaagaaaaaagcagaaaatctggtaaagaacatgaataagcaattcacaggaagggaaacaaaaaaacactagtgagtatatgaaaagatgctgaacctcattagtaatcagaggcatgcaaatgaaaatgagatcacgctacactcattggattggcaaaattagaaagctggatgatgccatgtcttgatgaggacatgcagaaatgtaatctcttatgcactgctcattatgaggataaagtattataaccattcgggagagcaattagatgatatttactaaaacgccgtttgcaggtgtcctgttatccagcaattctactcccagctacaatgacaggagactggcacagaatcagaagggagcatgtaccaggatgctcatggtgacacggtttgtaggggcaggaactggaaggcaatctaggtctccaacctcaggggaatgtatgaacaaaatatggtgaatgaacaccgcagatttctctgcagctgttagaagcaaagaactagatgtacttggagcagcatgaatagatcttgaaaaaaagtgctgaattaaaaaaacacaatgcaacagaaactgattcacagcttcaatgccatttatggacatttaaaatgcacacatatgcagaacaatgctttagcttttcgagcatatgtatcaaaacattaaaattggatgggtgcccctgggaaaaaggaaagtaggcaggggactgggaatgaagggaaagaaataaaactaaaagacaaaaggtttgcatagaccaatattgatgaagtgccacacactgaggagtgtgctgagctgcgtgaggtgcagagggaacctggaaaggagagagcaggagtatagaaaagtacagctcttgggaggctgaaggtcagatagtcaggtagcctggggtcaaatctgagctctgctgcttcccagctctttcaccttggacacgtcttccaagctccctcgcgtttctttttacgtcaaacaaggatacaagatgtatacacaagcagatagcagaattgctcctgacacacagtgggtacatgatgacattagtaaatttaaaactacaggccgggttttaaaactttagttttaacattagtaaatttaaaactacaggccggtggctcacgcctgtaatcccagcactttggggggccaaggcggatggatcacgtgaggtcaggagttcgacaccagcctaacaaacatggtgaaaccccgtctctactaaaaatacaaaaaagtagcaaagcgtggtagcaggcgcctgtaattctagctacttgggaggctgaggcaggagaattgcttgaacctgggaggcagaggttgcggtgagccaagatcacgccattgcactccagcctgggcgacagagagactctgtctcaaaacaaaacaaaaatgctacagagcaggaatgcacttccaagatctagtacaatgaatgtttctcaaatgcaagtggtaatttattaatgggtcatgaaataagtaatgggtcccaaacagcattaaaaagaaagattatcagagtacatttcactaaaagtatctttttatagaactgttatttcagttatatataatgagtactaaaatgcattttttccctatggcaggcaatcaaaaagtttgaaaaacatggatattgtccaaaggagttctacacctttgggcttcaagaaccagtaagtattccctgagacaaaagttgttcagggaggcaaccttttaatctataaagggcattcaaaaagaaacttttataatcttctcttactattgtaacataaaagaaaggacatttttaacattgtaaaaatagaacagaataacaggctttatgtaaaactcactactttgtacttatttttctcccttccctgtctttcggaacccgaggacagaatcccagaggtaggaatggactcactgaaggtcactgagtcagctgtgacagaggtgacacagaacccttatgtcctggcttcactttccaagctctgctcctcagaaccctaaggggtccacaaaagtggagcctagcaggtggggtctctagaatccccaaccctgttttactgggagtggccctgcttctgtgagatttcatttgaataaagaatttcactgtttaaaaaaaaaaaagaattagaaagctcctggggggcggaagccatgggagaatgctgcctcccaggatagggccagatcgcagaggttattatatttcaatttaaatttagatgtttttccctagtgacatgagggagctatttaggatttctaagcaagagagagaatagatcggggttgtgctgaaagataattactcaggtgcgagtgtaacagctggactggctgcataggaacagtgggaagtagagagcagctatttaaccattgcaaaggtcctggcatgaggctggggtgggggtgctgcctgaggcggcagggatgcagaagatggcacctcaaattctctggggttatggccagccaaagccaggctctccaagccataccccatatctccttttttctgctctaatacctgcttgggcagctctcccaggaacataggcatggggactccgaaggccctcacctgcagcgccagctggcagtcctcaatcaggccctgcaccaggtagtagcgtgcttcgcccagcagctcccccagttctctcgtactctccggcagtggcacagacccatcccgcaggtaattgaggattgtaccaaagtgacggccgctccggtcaatcagcacccaacctagtggggtggggagaggcagggggaaagatggctttgctgcgggacctggagctactaaattaaaaaaaaatttttgtagagatggagtctcactatgttgcccaggctggtcttgaactcctgggctcaagtgatcctcccatctcggcctcccaagtacttggattataggtgtgagccaccaaacctggcctaaattataagaaaaaaggattccagccaggcgcggtggctcatgcctataatcccagcaccttaggaggctgaggcaggcagatcacctgaggtcaggagtttgagactagcaggaccaacacggagaaaccccatctctactaaaaatacaaaattagctgggcttggtggctggtgccagctactcgggggggggcgaggcaggagaatcgcttgaagccgggaggtggagtttgcagtgagccgagatcgcgccattgcactccagcctgggtaataagagggaaactccgtctcaaaacaaaaaaataaaaaaagaaaagtaaagaaaagaaggccgggcacggtgactgacgcctgtaatcccagcactttgggaggccgaggtgggcggatcacctgaggtcaagagttcgagaccagcctgaccaacatggagaaatcccgtctttactaaaaacacaaaattagccgggcatggtggcgcatgcctgtaatcccagctactcaggaggctgaggcaggagaattgcttgaatccgggaggtgggggttgcggtgagccgagatcgtgccattgcactccagcctgggcaacaagagtgaaactccatctcaaaaaaaaagaaaagaaaagaaaagaaaagaaaaaggattccaaagccacaaaaaagtctgaatactgatctgtctcaaacctgtgccacagccaagaaatctctttaaaacatctccagcgagttctcccttaagtttttatacatattcaaccagataattaactcatccatatctggtctacagtcagaaggctctcaccatgagaaagttcttgcagaattaccttatcaataaactgttaacccccgaagttaattctcaccatcctatttaattaaaatgtctacctccccccgtccagttcactgccattttaacttttatattcttcatagagcttactatcaaaaaaagaaaaaagaaagaacttactactatctgcaattgcatatgcatatacattttgtttacttgcttattggtcttctgatctcccacttccctaaaaaaagggaatttccataattttgtcaggttcatttacctatctccagcactaactgatattttacaaatacttattggacaaatgaattcttcccttttttttttttttttttgagacagtctctctctgtcgcccaggctggagtgcagtggcgctgtctcggctcactgcaacctccgcctcccaggttcaagcgattctcctgtctcagcctcccgagtagctgggctacaggcgcacaccaccacgcccggctaatttttgtatttttagtagagacggggtttcgccatattggtcaggctggtctcgaactcctgacctcaggtgatccaccgcctcggcctcccaaagtgctgggattaaaggcgtgagccaccgcacctggccgaattcttcacctttgatacttgaaggcagatctccgcctctcaaatttttattctcctgctctcacagtcctcgttaacccctcccttaagactctcccactcccaaactccaaaacttcaaagtctcacttgggcacgaagggtccatacttgaatgcaacactccaagaaggtaaggttcacctgccaaggagacctgtccaccctccactctggtgtccctggcaaacccaaagcagcctccttctgcaatgtgtgtatacaggtggattcctagagtgtacagggacctgtgtcaggggaacacagaggcaaacaagatctcccagctctcctggctggctgtgagcagttctgaagcagagagggaaacaaaaggctgggcagtcggaagaaactgaggaaggctgccaggagtagtactgcaggcagcagggctagttcccaagtcttgagctgaggggtgaagggtgggagaggtggtcatgaggattatgaactgacacgttcaatcacttaccacagcgcctggcagttaggggttccgtaagtgttggttattgctgggggtaaaggattgggggaggagaagagaaattatgaatgagaaaggggaggagatgggatgtgggggctggagggagctgagaatgagttgactggacagtagcgggcagagagaaggggcatgaggagccccggtggtgagagactgcggggaacgggagttgggggtctggggtgggggcacggtaggggcgccgctcgtacctccggcatcggtcagcacctccacgcggccgctgaacatggctttgagcatggtgtcctgtcccgtgagggtgcgcagcgtggtgtagtgcaacgagccgcccacgttcagcttcacgtatttgctgttcggggtcagcggcttgagaccgtaggcggcggggccaggctcgagacccgagggcttgggggcttccagggacggggccgcggcggcagccgggcccgaggcctccgccgacatgccgggtagcagcggcggacggcgatcccaggatctctccgcgccctgcggcctgctcccgaagaccctcggccggcccccagcccttgggccagaccgctcggcgcacacgcccactcaccgcagctactctgcaagaccggccctccgccccatctcgctcgcaccacccggaagccggcgccgggcagctgcgcaggcgcggccccgcccctgaatgggggcggggctgcgagtatggagcatgcgcagtggcctcgctgggggatcccgtagaggtttggcgtgtggcctgcgggttccccgggcgggtcgacgtgcgctcctctctggtctcgagtcaccaggaccagatcgaggatgcggccgaccccctgcccgatgtggaaagcgaagtctccacctcgtgattgggtctctgctgtcagagagcttcacgagcttgaggggaaacagacagagaggtctgggcattgggcagtttcccgcctcccagccccgcgcactgaacagactgtgaccagaactgcgaacaaagcgcggagggaagctcttaaaggaggccaaagcggccgggcgctgtggctcacacctgtaaccccagcctgtaagcctagctactcgggaggccgaggcagaaggagcgcttgaagccaggagttggaagctgcagtaatccgtgatcggaccgttgcactctagcctgggcaacataacgtcctttgaaaaaaaaaaaaaaaacagaggccaaaacgggtagcagtggtgcccgggcaccaaggatggaaggcctctctgaggaggtgatgccgagctgaagctgggaagcggatgtgagggaagagttccaggcagagggaaggcaaatgcagagatcctcaggcaggaacactgaactgttctccgtatttgaggagcagagggcgtgtcagtggtggccgcagcagctgagcaaaggtcttagaatcccagctaatgtcgtgggacctagcacccaatcccaaaagaaagaagaatagataggaacccactgttgacaagaaggtgcactgagaagtgtttttatctgacccgatctgcatccagtttagaagccgatacatcagggatttaacaatctgtcttaatgtctagcaaggggggttgctggagggaaaacacagagtcagagttctatcttcagccctgccagcaggtccctgggagatgctagacgagtgacttttctctgggcgtggttggtgtaagggatgcacacgcaggaggaaggtcggagtgtaaatgtgtgacctgggcctgttactgggtataaatgggcctgtagtgaccgggagctcatgttctaccaaaggggttgccaattttctgatttcgagtgtggcggtgtaaaagagaaaagcaactgctgccagctgggagctggtttgcaccctcactccagaagccttgatgttgctaggagctgacctggcaccaacagcacggccatggtggtgtcctgttgagcaaaataatttcacaaaaaacatcagacaaggtcactctctgactgatctagaaaaagaccattccataataaagcctcaatacagaaacaagaacattgtccaaaccacaaaaattaccaacacaatcctctctcccacagcgtaagttactgctgctttttttttggttgttgtttttgtttgttttgttttgtttttgaaatgaagtcttgctctgttacccaggctggagtgcagtgatgcaatcttggcttaccacaacctccacctccaggttcaagcgattctcctgcctcagcttccagagtatctgggattacaggcacccaccatcatgcccagatcatttctgtatttttagtagagacggggattcaccaagttgcccaggtgagtcttgaactcttgacctccggtgatatgcccaccttggcctcccaaagtgctgggactacaggtgtgagccactgcacctggccactgctgcttctttaccaagtacagttttagcttgattcattcctcccatcttctagataagaattattaagataaccaaaaagaattatccctacttcctgatagcatccaacccagagcaaatgcccccctttttggacccgcctaggaagtcccctaatgaaagttccaatcctgtaataagtcctttcacacatgttcttgctgagatgtctgtggtgttcagcctcccttgttcaactacaggtgcttcctggtggtccttggttggagggtactatcagaaatggaggagcaacaaagattcagctgaagccctcactgcctgggactgggacccttgactcgtcattgtatgcacacctgaaactgcttatgtcgctgaggtgccaacctgctgatggttggaagctaattgagttctgatattgtgttgatacccttaagcattgggtttactttttattttaattaattaattaattaatttttgagacagagtttcactcttgttgcccaggctgaagtgcaatgacacgatctcggctcaccgcaacctccgcctcctgggttcaagcagttcttctgcctcagcctcttgagtagctgggattacaggcatgcaccaccacacctggctaattttatatttgtagtagagacagtttctccatgtttgtcaggctggtctcaaactcctgacctcaggtgatccacccgcctcggcctcccaaagtgctaggattacaggcgtgagccaccatgcctggccatattttttatttttcattttttactttttgagatagggtctcactctgttgaccaggctggagtgcagtggtacgactcagctcactgcaacctctgcttcccagctcaagtgattctccagtttcagcctcctgagtagctggcactaaaattaaccaatgccggttaatttttttttttttttttggcgggggacagagtctcgctctgtctcccagagtggagtgcagtggcgctatctctgctccctgcaagctctgcctcccgggttcaagcaattctcctgcctcagccttctgagtagctagggttacaggcatgcgccaccacacctggctaagttttgtatttttagcaaagatggggtttctccatgttggtcaggctggtctcaaactcctgaccccatgatctgctcaccttggcctcccaaagttctgggattacaggcatgagccaccacacccaggaatgccggttaagttttatatatatatttttttgtagagatagggtttcactctgttacccaggctggtctcaaactcctgagctcaaagcaatcctcccaccttggcttcccaaagtgctgggattatagatgtgagccaccatgccctgccaagcattgggtttatttggtttttcagtttttttactcctggaataaggcccccacactggatttttggttatctgatcaaatatttattttgtccttggtgcaattgttttctgtccttctacactcattcctatggtgttttcttgtctagtattttgaatattgtttgtctataagaggcaaagtcgatataaaaaggatggatgtaggctgggcgcggtggctcaggcctgtaatcccagcaactttgggaggctgaggtgggtggatcacctgagatcaggagttcaagaccagcctggccaaaatggtgaaaccccgactactaaaaatgcaaaaaattagctgggtgtggtggcaggtgcctgtaatcccagctacttgggaggccaaggcaggagaatcgcttgaacttgggaggcagaggttgcagtgagccgagttcgtgccatggcactccagcctgggcgacagagaaaaaaaaaaaaaagtctctgtctcaaaaaaaaaaaaaaaagaaaagaaaaggatggatgtgtagcctcggatgtctaagggcatcacaaacctattattgctgaatctctggtgaccgaacacaacttatccctctaggaaggtagggatgccaactgttgaggggttgtgcaactagttagcatccgagagtcttatttgttatcagaattaaccagagaaatcactccagcaaccaagagccagtaagtgtgtcctacaaccagctccagagactgtacaattcggaaggtattctcagactaatgtcctttgggtaaactttgcccaggtcaccatttcttttttgtttttgttttttgagacagagttttactcttgttgcctgctgaagtgcaataggacaatctcagctcagctgcaacctccacttcccgggttcaagtgattctcatgcctcagcctcctgagtagctgggattacaggtgcctgctaccatgtccggctaatttttgtatttttgatagagacagggtttcaccatgttggccaggttagtctcgaactcctgacctcaggtgatccacccacctctggctcccaaagtgttgggattacaggcatgagccaccacgcccagccccaggtcaccatttcaaagccttgaaaaggatttctttggttttgtctatgtccttgcaaactgctttgtttcatttcttctgctcagtatcagggggctttctctggcctctgatcagcgatggtgtttggccacattctagagatacgaagttgtataagcaccattcttttagaccccagtcacaactaaaattgggccaaagacctgctcccttcatgttttctcacgattgcaataacatgtacccatatatctgtaactgacacaatttcaccagggacagtttgtaattgccgtagccatttggtggaacttttgataataacaagattgttcatttgggaggtgcctcagaacacaaagggaagaaacctttgtgagattgtttgccttgtttgttaaaaacaaagattattttgtttaacataggcaatatttcatttacctattttgcatattaataaatgctgtcggccaggcacagtggctgacacctgtaatcccagcactttgggaggctgaggcgggcgaatcacttgaggtcaggagtttgagaccagcctggccaacatggtgaaaccccgtctctactaaatatacaaaaatcagccaggcttggtggtgcgcacctgtaatcccagctactttggaggctgaagcaggagaattgtttgagtccatgaagtggaggctacagtgaactgagatcatgccattgtactccagcctgggcaacaagagcaaaactccatctaaaaaaaaaagaaggccctcaccagatgtggctgcttgactttggaattcccaccctccagaactgtaagaaataaatttttaaaaataaagtacccagcccctcaggtattctattgcaacacagaatggactaagacagtgtttatatgtcaaaatctattttcctgtgtttaaactgtcttccttctccttgcagagggaatataaccttagccttttggagtgataatttcatgtttgtctgaagtagcttcttctcacattttctttttttttttttttatgttcaaaatgcttttatttctaggaatttagttttatttttaattttttaattattatactttaagttttagggtacatttgcacaacgtgcaggtttgttacatatgtatacatgtgccatgttggtgtgctgcacccattaactcgtcatttagcattaggtatatctcctaatgctatccctcccccctccccccaccccacaacagtccccggtgtgtaatgttcctctttctgtgtccatgtgttctcattgttcaattcccacctatgagtgagaacatgtggtgtttggttttttgtccttgccatagtttgctgagaatgatggtttccagcttcatccatgtctctacgaaggacatgaattcatcaatttttatggctgcatagtattccatggtgtatatgtgccacattttcttaatccagtctatcattgttggacatttggcttggttccaagtctttgctattgtgaatggtgccacaataaacatatgtgtgcatgtgtctttatagcagcatgatttataatcctttgggtatatacccagtaatggaatggccgggtcaaatggtatttctaattctagatcactgaggaatcgccacaccagcttccacaatggttgaagtagtttacagtcccaccaacagtgtaaaagtgttcctatttctccacatcctctccagcacctgttgtttcctgactttttaatgatcgccattctaactggtgtgagatggtatctcattgtcttctcacactttcctgctgtccatttcattctctttttcctcacctctcttggaaagctttaaagattaactaatcaaaaaatttttcagttgtatgtgcacagtctaggtaaatccagtcctaaaagaaatagaaatgcctaaaatgctaaaagaaacagaaaatcatatatatatacgtatatacatgtatatcaagatcagcttgggtaacatgtgagaccctgtctatacaaaaaaaaatacatgtatatacgtatatatatatagtgtctgtacatataggcactaaaaagtatatttatgtaatagcctttgctcttccagttagaagaaaagatctatcacgcctgtagtcccagcactttgggaggccgaggagggcggatcacgaggtcaggagatcgagaccatcctggctaacacggggaaaccccgtctctactaaaaaaaatacaaaaaaattagccaggcatggtggcgggtgcctgtaatcccggctactcaggaggctgaggcaggagaatcgcttgaacccaggaggtggaggttgctgtgagccgagattttgccactgcactgcagcctgggcaacaagagcaaaaactccatttcaaaaaaaaaaaaaaggtcttagttccaagacaaaagaagagcttttggcatgattcagttaaattttttattcactcatgtaaaaatgatgccagcgtgatattttggtttgtacaagaacagggttaattctctttctctctctctctctctctgagacagggtcccactctgtcaccccatctggactgcagtggcatgatcatggttcactgcagcctcaaccttctgggctcaagagatcctcctctctcagcctcccaagtagctgggaccccaggcacacaccaccatgcccagccaattttttgttgttgttgtatagacagggtctcacatgttacccaggctgatcttgagctcctgggctcaagcagttctcccaccttggcctcccaaagtgttgtgattacagacatgaaccactcactgctcctggccctcatgatttaagccttctcaatgtatttatgttgatcttatgagttaagtaaattgtgatggttttcataaattgtttaaatgaaaattatacacaggcactccttgttttattacacctcactttattgctcttcacagatattgcatttcttacaaattgaagatgtgtggcaaccctgtgttgagcaagtgttttttgtttgtttgtttgtttgtttttgcagtggagtcttgctcaggaggctgaggcaggagaatcacttgaatccaggaggcagaggttacagtgagccaagatcgcatcactgcactccagcctgggcaacagagcgagactctgtctcaaaagaaaaaaaaaaactggaacagcctgattgctgatatggagaaagttttagtggcctgaatagatcaaaacagccacaacagctctaaatctcttcattactatgaagactgagagggattaggaagctgcaggagaaaaatttgaaggtagcagaggctagttcatgagatttaaggaaatgagccatctgcagaacataaaagtgcaagatgaagcagcaagtgctgtgtagaagctgcagcaagttatccagaagatctagtaagataattgatgaagatggtttactaaacaacagatttccaatgtagacagaacagccttctattggaagaagatgccatctaggaattttatagctagagaggagaagtcaaagctttgaaggacaggttgactctcttgtcagggactaatgcagctggtctggtgactttaagttgaagccaatgctcattaaccattttgaaagtcctagggccctgaggaattatgctaaatccattctgcctgtcccctattaatggaacaaaaaagcctgaatggccacatgtctgtttatagcatggttcatggaatattttaagcccactgttgagacctagtgctcagaaaaagagattcctttcaaaatattatgacagttcctctggtcatccaagagctctaatggagatgtacaaggaaattaatgctgttttcctgcctactaatgcagtatctgttcttcagcccataagccaaggagtaatttcaattttcaagtcttcctgcagttgacccttgaacattgtgggggttaggggtgccaaccccaacacagttgaaaatccatatataactatttttcttttgtagagataaggtcttaatatgttgcctgggctggtcttgtactcctggcctcaagcaatcctcccacctcagcctttttctttttttttttttttttttgacagagcctcgatctgtcacccaggctggagtgcagtggtgtgatctcagctcactgcaacctccgcctcctgggttcaagtgcttctcttgctccagcctcccaaatagctgggattacaggtgtccgccaccacacccagctaattttagtatttttaatagagatggggtttcaccatgttggccaggctggtcttgaactctgaccacaagtgatctgcccacctctgcctttcaaagtactgggattacaggtgtgagccactgcccctggccttggcctcatataacttttgactccccccaaacttaactaccaatagcctactgtgaaccagaagccttaccaataacagaaacagtcaattaacacatactctgcatgttttatatattatatactgtagtcttacaacaaagtaaagtagagaaaagaaaatgttattaggaaaatcataggaagagaaaatatatttatggtactgtactgtattatgtataccataagtttatgtcgtatgtttataagatgaatcatctgtctgaaatggtgggcagccacagctgcagaccccaatccacattacatatcaagcagttgaacttttttttgtaatgtcatgactttcccctgcttcttagaagcacttccagcatgactagtggcacttcacgtgggtcccgtggtgttatacaaggcttacagtattgcactaaacacaataaagaacacaggagaaccacaagagatcactttttactgtaatacataatttactggagagataaactgctcatgtggagatgattagcatcacatagcatttaaaaaattattttttctgctgcactttaaaaattcttttactttttttttttattattattttgttgatgttgagatggagtcttgctctgtcacccaggcaggagtgcggtggcacgatcttggctcactgcaagctctgcctcccgggttcacgccattctcctgcctcagcctcctgagtaagctgggactacaggcgcccgccacaacgcccggctaatttttttgtattttttttagtagaaacaggatttcctcatgttagccaggatggtctcaatctcctgaccttgtgatccgccctcctcagcctcccaaagtgctgggattacaggcgtgagccactgtgcccggcctgctaattttttaattttaaattattatgggtgtattagtccattttcatattgctatgaagagatacttgagactcggtaatttataaagaaaaagaggtttaatagattcacagttccacatgtctggggaggcctcaccatcatgacagaaggcgaaggaggagcaaagacacgtcttacatggtggcaggcaagagagtgtgtgcaggggaactgccctttataaaactatcagagctcatgagacttattcactatcatgggaaccgcatgggaccatcttggttcactgcaacctccacctcccaggttcaagcgattcttgtgcctcagcctcccaagtagcggggattacaggtgcctgccaccatgcctggctagttattgtatttttagtagagatggggtttcaccatgttggccaggctagtctcgaactcctgacctcaggtgatccacttgccttggcctcccaaagtgctgggattagaggtgtgagccaaatttttcttgagttacaaaagaagaccatagagagtcaaaggtaacaggatgaagataaggaagatcagataaagaaaactttaattaaaagggtattaaagacaataacaggcaatatgaataacagaacaaagggtaggaaaacgggtaatgcacagccatagaaatgaacaaaatcatgtcctttgcagcaacatggatgcagctgaaggccattatcctaagtgaattaacacagaaacagaaaacctaatatcatatgttcttacttgtaagtaggagctaaacattgagtacacatggacataaagatgagaacaatagaagctgggaactgcagaggggaggaagggaggagaaagggctgaaaaacttgctattgttccctacttgggcgatgtgatcagcagaagcccaatcttcagcatcacacaacatgtcctggtaacctctgcatataaaattaaattaaattgaaaaaaaggaaaagggccaggtgtggtggctcacatctgtgatcccagcactttgggaggctgaggcatgaaaattttttgaggccagaagttcaagaccagcctaggcaacacagcaagaccctgtctctacaaaaaaaaaaaaattttaaattggctaggtgtggtgatgtatgcctgtatgtctaactactcaagaggctgaggtgggaaaaaattgcttgagcccaggagatcgaggctacagagagctatgaccaccactgcactccaaactgggcgacagagtgagatgaacccatcacccccctaccataaaaaagcagaagaagaaaggaagaaaataaaaaaggtaccgagtaatcaaataactaatcttgttctgttgtattccgcaggagaaggtgacatatgtcttttcatttgggaaatgtgaatccaaggatcaacaaacaagttttattattgtgtcagttacctgttaagatactttccttggccaggcttggtggccgacatctgtgatttcagcactttgcaaggctgaggtgggtggatcacttgagaccaggagctcaagaccagcctgggcaacaaagggagacctcgcttctaaaaaaattaaaaagattagccgggcattgtggtgtgcacctatggttccagctacttgagagactgaagcaggaggatcctttgagctcgtgaggtagaggccacagtgagccttgatcatgccattgcactccatcctaggcaaaagagcaagaccccatctcttaaaaaataaataatactttaaattttagaatacattgcatgaaacttaccatcttggcttttttttttttttttgagacagagtcctgctctgtcgcccaggctggagtgcagtggcgtgatatgggctcactgcaaactccacttcccagattcaagcaattcttatgcctcagtctgctgagtagctgagactacaggcacacatcaccacgcccagctaatttttgtatttttagtagggacggggattcaccatgttggccaggctggtctcgaactcccgacctcaggtgatccgcctgtctcggcctcccaaagtgctaggattacaagcatgagcggctgtacctggcccatcttggcaatttctttttttgaaatggagtttcgctcttgtcaccaaggctggtgtcaagtagctgggattacaggcgcccgccatcatgcccggctaatttttgttttgttttgttttgtttttgagatgaagtttcgctcttgttgtctaggctggagcgcaatggcgtgatcttggctcactgcaacctctgcctcccaggttcaagcgattctcctgcctcagcctcccgagtagctgggactacaggcgcccgccaccacacctggctaatttttgtatgtatagtagagacagggtttcaccatgttgaccaggctggtcttgaacttctgacctcaggtgttccacccgcctcggcctcccaaagtgctgggattacaggtgtaagccaccgtgcccggcctaatttttgttttttttttaatagaggtggggtttcaccatgttggccaggctggtctcaacctcctgacatcaggtgatccacctgccttggcctcccaaagtgctgagattacaggcgtgagccactgcacccagccaacatcaacaattttatagaacaccacgacagagacaaggccactctatgactgtggtggatcagacaaaaacaaagccactgtgtactcatgatgtctgaacacagacaaaaacaagaacattgtccaaactatttagtcctgctcctttctcccacctttcagttgaaaattacggtactcagacatagaattacctcttcctggccgggtgcggtggctcatgcctgtaatcccagcactttgggaagccaaggcaggcagaccacgaggtcaggagatcgagaccatcctggctaacacagtgaaaccccgtctctactaaaaatacaaaaaaaattagctgggtgtggtggcgggcacctgtagtcccagctactcgggaggctgaggcaggagaatggcatgaacctgagaggcggagcttgcagtgagccaagatcgcgctgttgcactccagcctggagacagagcgagactccatctaaaaaaaaaaaaaaaaaagaattaccccttccttcctgatgcatccaaaccagagcaaaccctcttgcctcaaatcctctcctgaaacataacacgagcataagtcctacaataagtctttttttttttttttttttaattagacacgtggggtttcactatgttgcccaggctggtcttgaactcctgggcctaagcgatcttcctgccttggcattccatattgctgggcttacaggcgggagccaccatgcccagtctaagtcatcttcaacacctctttctgagatgccttagagttccccatattatgtgggtctgcctcattgctatgagtccgtaaaactgactttgttttttgttttgggttgtttttttttttttttttttagacatggtctcattctcttgcccaggctggagtacagtagtgcaatcatgacctactgcagcctcaacctcccaggctcaggtgattctcccacctcagcccccttgagtagctaggactacaggcacatgccaccacaccccactaattttttgtattttttgtagagatggagtttcatcatgttgcccaggctagtctcaaacccctatgttcaagcaatcctcccaccttagcctcccaaagagctgggattacatgcatgaaccaccacactcagtcccccaacgttgttttaaaactttcttttaggtgtgttcttggtggcccttaacagaaggacattgacactggaatctggatgtttgtttgttttggagacaggatcttgctctgtcacccaggctggagtgcagtggcacaatctcggctcactgcaacctctgcctcctgggttcaagcgaatctcgtgcctcagcctcccaagtagctgggattacaggtgcctgccaccacacctggctaatttttgtatttttagtagagacagggattcaccatattggccaggctggtcttgaactcctggcctcacgtgatccacccacctcggcctcccatagtgctgggattataggtgtgagtcactgcacccggcctggatttttttttttcagtgaaagatactgattttttttaagttgactcaaagcaagttttaaacactctgtgtccacttcatgttgctatcacagaatatcacagtctgcgtagtttaggaacaatagacatttatttggcttatggttctagaggctgtgaagtccaagatacaggagctgcctctggtgagacatcatcacgtggcaagagagcatgagagagagaaagagggggctgaatttgcttttataacaaacccattcctgaaataatggcattaatccattgacctaattgcctcttaaggatctcacctctcaacagtattacatcagggattaactttccaacacctgagatttgagggactcattcaaaccatagtactctgaaattggatatataggtctatgggtgagattcccactgagggttgccagtttgcaacctttcagttgaatggtctccctcctggatgtcaaggttaatactgctatgaacagctattatgcacctaagttgaaccagggagagaacacatccttccgcatgtactattttatttaatgttattttctactaagtcattcagaactctctggactctcttcatgctgtgtaatttgcaaggttgcctgctgcatgtttggttataaatgaggtcaaatcccaattttgcaggaggacgtggatgtatgcccattcccttcacactgtgagccagtagccatgggaactataatcaagtacacaataactcccccatgaacaaatcctcagggaacaagcttcaattgaatgaaactggcttgaccacagaggaatctgggggactttctgagcttcgcggacttgtgccgcctcctgactttaagctggctctggaggaggaggaagtggaggtatctcaggtatggacctctttctggaagctgggacttggaccaggcaaagaaaggaggcggtggggaaaattcccccagagaaggcaggagtgggccctgcataccaggtccccaggtctctgagagctttactagttctgggagtgtgtggatcaagcctaaagtctagaaggaattctagcatcacccagggcgttggctggaatatctttaaggacccttccagccctggaatcatagcagcaaaggacccaattgtatgacagctgctttggccagtgaagatggaaagaccaggaaaagctttaggctaagcaatggagttcacaccccgctaattcacctcccttgcggcatccctgacatttcccacacaatatgtccttcattctgttctccaaaaagccattgccttcctctaactgactgagatgagccctggaaaccctgatgcccaccagacccctgcctttcctcttctctgctgttggccaaggtttctgcctcagttgccctgtctgacaatacagtttccctaggactggagctagccctggcatcccagaatccccaacaggtgctagcccctggagtcaggactgtcttcctgtgtccctgtgcttgctgcagaataaactgattacttttaactaccattctgaatatagtcactaccaggaaccgctgactacctgtgacataccatctagcatggtaccacagcacctggcccagcatcttgggaggccaaggtgggaggactgcttgagggcaggagtttgagatcaacctgggcaactacatagtgagaccccacctctacaaaaaatttcaaaattagccgagtgtgattgcacatgcctgtagtcccagctacttgggaggctgaggcaggaggatggattgagcacaggaagtggaggctgcagtgagctatgattgcaccactgcactccagcctgggagacaaagggagattccgtacataaataaacaaataaataaaaaacaaaggagatggatttttttctacaagagagttacatgcagggtgctaggtactataggtggagacttgccgaggttcagtgggaatgggagctcaatcctgagagtgggggaaggcattacagaggctgtgacctttgagactggtcttgaagaaagagaaaatgtgtacaaggcagaaagaagggagaaagttacccgaagagagaactgcaccagccaaaaatatggaggtatggagtaggtagaattgtgagacatttatgtgactggagtgaaaaatgagagatgatgctggaaaggagagttaaggccaggttttgaaggatctcttaaaaaaataataggctggcgagattgtgccactgcactccagcctgggcgacagagcaagactccgtctcaaaaataataataataatagtaataataggctgggcacagtggttcacacctgtaatcccagcgctttgggaagccaaagcgggcagatcactcaagatcaggagttcaagaccagcctggccaacacggcaaaaccctgtctctactaaaaatacaaaaattagctgggcgtggtggtgtgcacctgtagtcccagctactagggaggctgaggcagaagaattgcttgaacccgggaggcgaaggttgcagtgagcagagattctgccactgcactccagcctgggtgacagagcaagactctgtctcaaaaaattaataatgataataatacattaattttgagataagatcttgctctgtcgcccaggctggagtgcagtgatataatcacagttcactgcagcctcaagctcctgggcttaagcgatcctcctgcctcagcgtcccaaggtgctgggactacaaccatatgacactgacggagcaagagcactgtcatctgggacaaacaccgcccctttaagttacagctccctttctagcctcatgcatttcaaggaaatcacttctcttctaactacaagcagacagaaagagcagacaggaaaacgcagataagacagtttgggcatagagggaggtgggggcaaagtctcttgggtaactgccaaacttcaccctcatacaacgggccccagtaaaacagtgggccttaggccgggcgtggtggctcatgtctgtaatcccagcactttgggaggctgaggtgggcagatcacgaggtcaggagttcgagaccagcctgatcaacacggtgaaaccccatctctattaaaaatacaaaaattagccgggcatggtggcgcgcgcctgtaatcccagctactcaggaggctgaggcaggataatcccttgaacctgggaggcagaggttgcagtgagcctagatcacgccactgcattccagcctggacaacagagagagattgtctcaaaacaaacaaacaaaaaaataatgggccttaataagcacatttctttcccttcagttgcactaagatagggaagttaaaagcagactcaggggatatgcctatagctgcagaaaaaagataagcacaagataagcacaacaaagagacacagaagcagtccaagcctctgataaactctcccaccctgaatccttacaaactctttgtaagaaagggtggctctgacctaacttggccagctgccaagtttattattcaaaataaacctgtccctgatgactgtcaaaccacccttcatgtttctctcctctttctttaattcttacagccaccacgcctggctaatttttttgaatttcactggaggtcttgctgtgttgcccaggctggacttgaactcctgagctcaagtgatcctctcgcctcagcctccgagtgttgggattgctggaggatcatatctgtttccaaaggtggagctttctgctggaggcagcagagttcttcaggcagagcagctgagtcttgaggttgctcttttaggaaacaaactcaggaggcgctgtggaagatgcattgaatggagtaggaggtggaggcagcgagaagggtgaggagacactgctgagccctgatgagagacaaagaatgtctgaaggaagcaaagggaatggagaggaggggaaggctttgggaagactgtgatgcatggaatgcgtgggataagggcagagggtggagtccaggctgactcagaggtttattgcctgggagactgggtagatgattacactgtaacctgagatgaagatacagtaagaggagtttatatgaagaaaaagtaggccaggcgcagtggctcacgcccataatcccagcactttgggaggctgaggcgtgtgaatcaccttagccccagagttccagatcagcctgagcaacatagagaaatctcatctctactaaaattcaaaacaattagctaggtgttgtggtgcagacctgtagtcccagctacttgggagtctgagatgggagaaccgcttgggcccaggaggtcgaggctgcagtgagtcatgatcgtgctactgcactccagcttgggcgacagagcaagacactgtctcaaaaggaaaaaacagaaaaagtaataagctcagtttttaaacagaaattgtagtagaatacaatgtaaaatttaccatttaaccattttacagtgtacaattcagtggcattaagtaaattcacaatgtttgaaagcatcaccttgatctagctccaaaacattctcatcaccccaaaggaaacccccaaatccattaggcagtgattctctattcccctgtgtgcccagcccctggcagtccctaatctccctgtagatttgcctgttctggacatttcatatgcatggaatcatacgatatgtgactatagtttatggctggccactttcacttagcacaatgttttctttctttcttttttttttttttttttgagacggagtctcgctctgtcacccaggctggagtgcagtggcacgatctcggctcactgcaagctccgcctctcggggttcacgctattctcctgcctcagcagagtagctgggactacaggcgcccgccaccacgcccggctaattttttgtatttttagtagagatggggtttcaccgtgttagccaggatggtctcaatctcctgacctcgtgatccgcctgcctcggcctccctaagtgctgggattacaggcgtgagccactgtgcccagccagcacaatgttttcaaggttcatccatgttatagtatgtatcagaattcttttttttggagactcagagccccattttttttggagactcagagtctcattctatcacccaggctggagtgcagtggtgcaatcttggctcactgcaacctctgcctcccaggttcaagtgattctcctgcctcccgagtagctgggataataggcaaacgccaccatacccagctaatttttgtatttttagtagagaaagggtttcgccatgttggtcaggctggtctcgaactcctgacctcaagtgatctatctgccttggcctcccaaagtgccgggattataggcgtgatccaccgcgcctggccccttacccatttttcaattggtcaattttctttttcttattgaattgtaagagttatttctatgttttaaatacaagtactttatcagatgtaagatttgcaaatactttttcccattcggtgagctgtcttttcaccttgtggctggtattcttttttttttttttttttttgagacagagtcttgctctgttgcccaggctggagtacagtggcaggatctcggctcactgcgagctccacctcccgggttcacgccattctcctgcctcagcctcctgagtagctgggactacaggcgcccgccaccatgcccggctaattttttgtatttttttttagtacagatggggtttcacggtgttagccaggatgctctctatctcctgacctcgtgatccacccgccttggcctcccaaagtgctgggattacaggcgtgagccaccgcgcccggccttgtgggtggtattctttgaaacacaaaactttttattttgatgaagtcccctttatctatttttacttttgttacctgtgcttttggtatcatatctaagaaatcattgccaaatacaatatgatgaagattttcccctatgttttattctaggatttttatggtttttgcacttaagtttagatctttgatccattttgagttaattttttgtatgtgagctaagctttctatgtggggtacagaaaagggctaacctcattattttgcatgtttcccccaccccctgcccaccaacatttgtcaaaaatacgaatcctttcccccattgaatagtctaaacaactattttcaacaagggaaaatagttgaaaatcaattgttgaaaatcaattaaccatatatgtgaggatttatttctgggttctctattctactccatttgtttctctatctacccttaggtcagtatcacactgggttttttcttttgtttgttttaactttttaaatttcttgtttttaatttttgtgggtacgtagtaggcatatatatttatagggtacaggagatactttgatagaggcatgcaacgcataataatcacatcatgataaatggggtatctatcccctcaagcatttatcctttgtgttacaaataacccagttaaattctttcagttattttaaaatatacaattaaattattattgactggcctggcgcagtggctcgtgctgtaatcccagcacttttggaggccgagatgggcggatcatttgaggccaggagttcaagaccagcctgaccaacatggtgaaactccatctgtactaaaaagacaaaaaaagttagccaggcctcaggcgcctgtagtccccactactcaggaggctgagacaggagaatggcgtgaacccaggaggcagagcttgcagtgagctgagatcgtgccactgcactctagcctgggtgacagagcgagactccatctcaaaaaaaaaaaaaaagttagccaggcctaggggtgcacgcccatagtcccagctacttgagaggctgaggcaggggaattgcttgaacctgggaggcggaggttgcagcaagccaagatcatgccactgcactccaccctggttgacagagctagactccgtctcaaaaaaaaaaaaagaatggcctggcgctgtggctcatgcctgtaatcccagcactttgggaggccgaggcggggggcagatcatgagatcaggagttcgagaccagcctgaccaacatagggaaacccgtctctactaaaaatacaaaaattagccaggcatggtggtacatgcctgtagtcccagctactcaggaagctgaggcaggagaatcgcttgaacctgggaagcagaggttgcagtgagccaagatggcaccactgtactccagcctgggcaacagagcaagactctgtctcaaaaaaaaaaaaaaaaagaagaatcatattgctaaaaaaaatagtttttcattctgtctatatgtcataagtgagatgacttgaactccctaagcatatgtgtccattatttccaccattaaaatgaattaaggtgcttggcatgactgccccctgtttattagttctaatagttttttagtggagtctatgttttttctaaatataagatcttatcatctgcaaacaagaataatttttacttcttcctttccaatttggacgccctttgtttctttctcttgtctaattgttctagctaggtcttccagtactatgctgaataacagtggtgaaagtgggcatccttgtcatgttccagatcttagaggaaagtctttcgggttttcctcattcagtatgatactagctgtgggtctgtcatatatggtttttataatgttgaggtatgtttcttctacacccagttttttgagggtttttattatgaagtagtgttgaattttatcaaatgctttttcagcatcaattgaaatgatcatatggtttttgtctttcgttttgttgatatgatgtaccacattaattgatttgtgtatgttgaaccatccttgcatccctgggagaaattccacttcgtcatgatgatctttttttttttctgaggtggagtcttgctctgtcacctaggctagagggcaatggcacaatctcagctcactgcagcccctgcctcctgagttcaagtgattctcctgcctcagcctccccaggagctgggactacaggtacatgccaccacacccagctaattttttttattgtagagtcaacattttgccatttacccaggcaaaatgagtaacattgtgacctcctgggttaaagtgatcttcctgccttagcctatcaaagtattgggattataggcatgagctaccatgcccagccaaatactatcttattacccattattttaaactgataactgatgacaacttttttttttttttgagacagagtctcgctctgtcgcccaggctggagtgcagtggcacgatcttggctcactgcaagctccgcctcccgggttcgtgccattctcctgcctcagcctcccaagtagctgggactacaggcacccgccaccgtgcccaactaattttttgtatttttagtagtgacggggtttcactgtgttagccaggatgatctcgatctcctgacctcgtgatccacccgcctcggcctcccaaagtgctgggattacaggcgtgagccaccacgcccggcaaactgatgacaacttaacactggttgcataaacaaacaaacaagcaaaatgaaaaaaaaaataataaaaactctacactttaacttcctccccccctgctttttttttttttttttttgagatggagtctcactctgtcgcccaggatggagtgcagtggcgctatctcagctcactgcaacctctgccttccatggttcaagcgattctcctgtctcagcctcctgagtagctgggactacaggtgcacaccaccacacctggctaatttttgtatttttagtagagacggagtttcaccatattggttaggcttgtcttgaactccagaccttgtgatccacccgcctcagcctcccaaagtgccgggattacaggcatgagccaccgtgtccagcccccactgctttttaatgtggttccctttatgtcttattgtactatgccttgaaatgttgtagttattgtttttttattggttcattgtttagcttttctacttaagagtagttggccaggcgcagtggctcatgcttgtaatcccagcactttgggaggcctaggtgggtggatcacctgaagtcgggagttcaagaccagcctgaccaacacggagaaaccctgtctctactaaaaatacaaaattagctgggtgtggtgatacatgcctataatcccagctactcgggagactgaggcaggagaatctcttgaacccgggaggaggaggttgcagggagtcgagatcgcaccattgcactccagcctgggcaacaagagtgaaactccatctcaaaaaacaaaacaaaacaaaacaaaaacagataatggtagtttatataccaaaattacagtgttataataccctgtatttttctgtgtgcttgctattaccagtgaattttgtaccttcaaatgatttcttattgctcatgaacatccttttctttcagattgaagaactccccttagcatttctcgtaggacaggtctggtgttgatgaaacccttcattttcgtttgtctgggcaagtctttatttatccttcatgtttgaagaatatttttaccagacatactattctagggtaatttttttttcttttagcactttcaatgtcatgccattctttcctggcctgtaaggtttccactgaaaagtctgctgccagatgggaattggagctccattgtgtgtttttttgtttgttgtttgtttgtttgtttttctgagatggagtctcgctctgtcgcccaggctggagtgcagtggcgggatctcagcttactgcaaacttcacctcccaggttcaagcgattctcctgcctcagcctcctgagtaactgggactacagacatgcaccaatacacatgtgtgtgtgtgtgcgtgtgcgcgtgtgtgtgtatttttagtagagacggggtttcaccatgctggccaggctggtcgtgaacttctgacctcaggtgatccacccacctcagcttcccaaagtgctgggattacaggcgtgagccaccacgccttctaatgcattctttagtatgtcaattgcattttccaactctagaatttctgcttatttttagttatttcaatctctttgttaaatttattgatagaattctgaattccttctctgtgttattgtgaatttctttgagtttcctcaaaacgtcttttttgaattctctgtctgaaaagtcccatctgtgtttctccaggattagtccctggtggcttctttggttcatttggtgaggtcatgttttcctggatggtcttgatgcttgtcaatgttcatcagtgtctgcacattgaagagttaggtatttattgtagcctttgcagtctgggcttgtttgtgcccatcttttttgggaaggctttccaggtatccaaaaagacttgagctccaagcccaataacactgtggttcttgtggactcatataagtaccaccttggtggtcctagataagatccagatgaattctctgattactaggcagagactcttgttctctttccttactgtctcccaaataaatggagtctctgtctctttgctgagcttcctggagctaggggtggggtgatgcaagccttcttatgaccaccaccattaggactgtgctgggtcatacctgaagccagcacagcagtgggtctcacccaaggcccactgtaaccactacccgaataccatctatgttcactcaaggccctagggctctacaatcagcagctagggccaccagtctgatttctatctttcccttcagggcagcgagttcctccaggtcctgggagggtccagagataatgtctgggagccacggattagagtcaaaaaccttagaaatctacctggtgttctattctactgcagctaagctgggactcaaaccacaagacaaagtgcctcccactctaccttcccctttccatggacagaggacagaggagcctctcccagtggccactaccaccactggcctgcagagagttctgaacactcacttaaagcccaaggcctcttcaagtcaacttgtggtgaatgctctcaggcctgggactcaccctttaggacagtgggtccccctctggcccacagcaggtccaaaaatgttgtccaagagcttaggtctggactcggggaccccaaaaatctgcttggtaccctaccccactgtgtccgagctggtatctaaggggcaagacaaagttccctttactcttctctccacttttctcaagcagtagtctttcaccagggccaccacagctggtaatgtgctgggccctacctgaagccagcacaactcagactcttatccaaggtccacagatactacctgggtattgctgttggctattcagggaccaagggctccttagtcagcaggtgataagcccttccaggactgcgtcctcccttcaggacagcaggctcccttctggcccagcgcatgtctaaaaatgtcatccaggagctagggcctggaatgagggcctcatgactgcctggtgctctatcctattgcggctgatctggtatccaagatgcaagacaaagtcctctttactctttgctttcctctcctcaaacacaaggaaggagttactttcgttgctgtgagctatgccgcctggaatcgggggaagggtggtgcatgcactcctttagctgccccaactactgcctagctaggtcatgtgccatcctagtccactggctctaaggccagcccagcactaggacttgcctagaagttgcagtccttgtatcctaaaatgcctttcaaatttacctaggaccccagagcactttagcctgcagtggcaaggcttgccgcaacttgagttctgaccactaggatggacaattcccctctggttcgggctgatacaaatgctccctccttgggcaggcactggctgagtccagcatggctttgctctccactgtgacagggcagcactgagttcactggcaagtccctcagttcaatgccaagtcccccagtccatgtgctctctctcctccaagtgcacagtttctctctgtgccatgcagctactgctagggggttggggaggggtggtgtcagcgattcaagacagtgtttcctgcccgggcacggtggctcacacctgtaatcccaacactttgggaggccaaggcaggcggatcacttgaggtcaggccaacatggtgaaatcccgtctcactgaaaatacaaaaacccggcgggcgtggtggcacatgcctgtagtcccagctactagggaggctgaggcaggagaatcgcttgaacccgggaggcagaggtttcagtgagccgagactgcaccattgcactccagcctaggcaacagacaaagggagacttcatctcaaaaaaaaaaaaaaaaaaaaaaaggctgtctttcctaccctcttcagtgcctctttcagtgatatgaagttaaaatcagctactgtgaccactcacctgatttttggttcttatgatggttctgaggaggcttctattctgccatcttgctctgacttcccactacattgtgttttgtttgtttgtttgtttttgacattcactctgtcacctaggccggagtgcagtggccaaatctgggctcactacaacctctgtctcccaggttcaagcaattctcgtgcctcagcctcctgagtacctgggattacaggcgcttgcccccactccggctaaatttttgtatttttagatggggtctcaccatgttgcccaggatggtattgaactcctggcctcaagcgatcctcccgcctcagcctcccaaagtgctgggattacaggcatgagccaccacgcttggcccccctacagtttttgtttggttgtttgtttgagacagagtctagctctatcccccaggctggagtgcagtggcgaaatcttgtctcactgcaacctccgcctccggggttcaagcgattctcctgcctcagcctaccgagtagctgggattataagcactcgccacccagttaatttttgtatttttagtagagatggggtttcgccatgttgaccaggctggtctccaactcctgacctcaggtgatccacccaccttggcctcccaaagtgctgggattacaggcgtgagccactgcacccagcccctacactgttttgattatgatagctttgtagtaagttttaaaatcaggaaattgagtccttcaactttttttcaagaccattttggtattcagggtcccttgagattctgtatgaattttaggatgggtttttctgttccactgccctccagcctgggtgacagagcgagactccatctcaaaaacaaaaaaacaaaaaaaaaaatcatagggatttgatatgatttgttaggaatttgcattgaaactgcagatcgctttgggtagtattgccatcttaacactattaagtccttcaatccatgaatgtgggatgttttctcttttgggggtcttctttaatttatttcagcagtatattgtaattttcagtgtacaaatctttgagctccttggttaaatttctaagtattttattattttgatgctattgcaaaggaagttattatttaaatttccttttcaaattgtttgctgcaagtgtataaaatctgagttgattttatgtcctgcaactttgctgaacttaattctaaaatttttgtgtggatttcttatgatttttctatatataattatataatctgtgaaaagagatccttttacttcttcctttccaatgtggaagtcttttgtttcttcttggcgaattgctttgcctagaacttctagtactttgttgaatagaagtggtgagagcaggcatccttgtcttgttcctggtctgagggtacaagcttttagtctttccctgtagagtatgatgttagctgtggtttacggcctttatcatttggaggacattcctgtctatttctagtttattgagtgttttaatcatgaaaggggtttggctgggcgcagtggctcactcacgcctgtaatcccagcactttgggaggccgaggcaggcagatcacctgaggtcagaagttcgagaccagcctgaccaacatggagaaaccccatctctactgaaatacaaaaaaattagccgggtgtggtggcgcttccctataatcccagctactccagaggctgaggcaggagaattgtttgaacctgggaggcagaggctgtggtgagccgagatcacgccattgcactccagcctgggcaacaagagtgaaactccgtctcaaaataaataaataaataaataaataaataaataaataaataaataaataaaatcatgaaagggtgttcattttttcaaagccttttctgcatcaattgagatgaccatgtgttttctccccggttcattctattaatgtggtgtattacattgatttttttcttttttttaagacagagtcttgctctgtcgcccaggctggagtgcagtggcttgatctcagctcactgcaacatctgcctcccaggttcaagtgattctcttgcctcagcctcccaagtaactggtattataggcacctgccatcatgcatggctaatttttgtatttttagtagagacggggtttcaccatgttgggcaggcttctctcaaactcctgacctcaggtggtctggctgcctcggcctcccaaagtgctgggattacaggtgtgagccactgcacccagccacactttgcatattttgaagtgcatctatttacttagcattcgtgacttgaataatttcaccaaatgaataattttgggtagtttgaaattcgttcttccaattgttacaccttgtttggtgtttgtaataaacacgtaaaggtaaaaaaaaacagtttttctgtattctgccaatcatacttttatataataaatcatccatttttttcccataaaaaaaaagaaagttattgcttaatgttacagaatttctgtttggagtgatgaaaaagttttggaaatagtagtgacagttgcacaaaattgtgaatgtaattaataccactgaactgtgcacttaaaaatagctaaaatggccaggtgcagtggctcatgtctgtaatcccagcacttccggaggccaaggcaggtggatcacctgaggtcaggagttcaagaccagcctggccaatacggtgaaacctcgtctctactaaaaatacaaaaaattagccaggtgtagtggcagacacctgtaatcccagttacttgggaggctgaggcaggagaatcacttgaactcaggaagtggaggttgcagtgagccaagattgcaccattgcattccagcctgggcaacagagcgagatctgtctcaaaaaaaaaaaaaaaaagctaaaatggcaagttttatattatatatgttgtttaccacacacacacacacaaatactaagaaaaaaatcaggcagatcctcttctaacaacacttacagtctattaagtgaatctgggcattttaaagaaaaaaataactatttttggttacggaatcaggatagtagttgcctatggacacgggcagtggggactgactagaaagggaagggaaggaagttcttggacctagaagtgttttatgtcttgattggggtgtttagataggcattacatttgtcaaaactcatgaaattttatactttaagatctgtgcatttcactctatgtaaattttaccttagtaaaaaacaaaacaggctgggcgtggtggctcacgcctgtaatcccagcactttgggaagccaaggtgggtggatcacttgtagtcagaggtacgagaccagcctagcaacatggtgaaaccccatttctactaaaaatacaaaagaaattagctgggtgtggtggcaagcgcctgttatcccagctacttaggaggttgaggcaggagaatcgcttgaacctgggagctggaggttgcagtgaactgagatggacccactgcactccagcctaggtgaccgagcgagactccatctcaaaacaaaacaaaacaaaaaatgttagcaacttctaatcccttgacagtttatatataccgcagtgattttctcccacttctcactcacgtgggatcttatcatacagaggttttaaattttaaacaattaaatttatcaaccttcttcatttatggtttctatatttgtgtgtcttgcttcagaaagtatctcttattccaggtaatcatattatcctatttttaaattctattttggaataaatatttcttattccaggcaatcatattattctattttttttctatatttttattgttctttcctgtgtgggacatgtagctggtgggctagctgcagaccacgggcaagtttgctaacattgctaagtcttggttttctcatccataaaatagggataataatttgctttgttattgacatgatttaataaagtaatatttatttgtttatgtatttattttagagacagggtcttactctgttacctaggctgaagtgcagtggcaatctcggttcattgcagctcaagtgatccttctgccttagcctccagagtggctgggactacaggtactgggactacaggatgggactacagagtggctgggcatccagctaacttaaaaatttttttgggctgggtgcagtggttcatgcctgcaatcccagcactttgggaggccgaagagggattaagaggtcaggaatttgagaccaacctggccaagatggtgaaaccccgtctctactgaaaatacaaaaattagccgggcgtggtggcaggcacctgcagtcccatcaggaggctgaggtgggagaatcgcttgaacccgggaggtggaggtggcagtgagccgagattgcgccattgcactccagcctgggctacaagagtgaaactccaccttaaaaaaaaaaaaaaaaagccgggcgcggtggctcacacctgtaatcccagcactttgggaggccgaggcgggcagatcacgaggtcatgagatcgagaccaccctggctaacatggtgaaaccctgtctctactaaaaaatacaaaaaattagctgggtgtggtggcaggcacctgtagtcccagctacttgggagactgaggcaggagaatggtgtgaacccaggaggcggagcttgcagtgagcagagatcatgccaccgcactccagcatgggcaacagagcgagactccgtctcaaaaaaaaatttttttttggccagtcacgatgtgtcacacctgtaatcctagcacttagggaggccaaggcgggtggatcacttgaggtcaggagtttgagaccagcctggccaacatggtgaaaccccgtctctactaaaaatacaaaaattagccagggacagtggcatgcctctgtaatcccagctactcaggagactgaggcaggagaatcacttgaacccaggagttggaggttgcagcgagccgagatcacaccacttcactccagtctgggcgacagagcaagactccatctcaaaaaaaaaaagtctagatggggccgggcagggtggctcacacctgtaatcccagcactttgggagtctgaggcgggtagacggcttgagctcaggagttcgagaccagactgcacaacatggtgagaccccgtctctactaaaaatacaaaaagagagaaaaaaaaatagcttggcatggtggtgcacacttgtggtcccagctacttgggcggatgaagtgggaggattgcttgagcatggtgaggagggaggttgcactgagccaagattgcgccactgcccaccagcctgggtgacagaccaagaccctgtctcaaaaaaaaaaagaaacaaaaaaaaggtggggctcactggctcacacctgtaatcccagcactttgggaagcttaaggtggatggatcacttgaggtcaggagttcgagaccagcctggatgacatggcaaaaccctgtctctactaaaaatacaaaaaaattagctgggcctggtgacgcacgcctgtagtcccagctactagggaggctgaggcaggacaattgtttgaactcaggaggcagaggttgccgtgagctgagatcgcaccactgcactccagcctgggtaaccagagtgaaactctgcctccaaaaaaaaaaaagaagaagaagaaaaaaggtttaggcaaacatgcacttttcctgttgcttttttttttttttttgagatggagtttcgctcttgttgtccaggctggagtgcaatggcgtgatctcggctcactgcaacctccgcctcctgggttcaagcgattctcctgcctcagcctcccaagtagctgagattacaggcatatgccaccacgcccgaataattttgtatttttagtagagatggggtttctccatgttggtcagactagtcttgaactcccaacctcaggtgatcctcccgcctcggcctcccaaagtgctggggttacaggcatgagccactgcgcccagcctgaacatgccagattgtagttccaggaggccagagatcatgaatactttgtccaccactatattcccagcccacagaatacacagcctggcagccaacagatgcttattgaatgaacgagcctcaacagggctttctcattcccacatgccatgctgtggtcaggcttaaatcataacccaacttctgccacctaatatatgtatgaccttggttaaattaaaccagcagtccccaacctttttggcactggggaccagtttcatggaagacaatttttccaccaggggaggaatggtttcgggatgattcaagcacattacatttattttgcactttatttctattattattacattataaggtataataaaataattatacaactcatcataaagtagaatcagtgggatccctgagtttgttttcctgcaactagatagtcccatctgatgttgatgggagacagtgagagatcatcaggcattagattctcataaggagcaacctagatccctcgcatgcgcagttcacaataggattcatgctcctatgataatctaatgccgctactgatctgacaggaagcagagctgaggcggtaatgcaggcaatggggagtagctgtaaatacagatgaagcttctctcaccagccattcacttcctgctgtgcggctcagttcctaacacgtcacggactggtactggccccacggcccaggggttggggacccctgacttaaactaagggccagctttccagaataacatccactttgagggcttgttgagtggattaagtcaaaatgttggtatacttggctggtgcggtggttcacacctgtaatcccagcacttcgtgagtctgaggcgggtggatcacctgaggtcaggaatttgagaccagcctggccaacatgatgaaaccccatctctactaaaaatacaaaaaattaggccgggcgcggtggctcacgcctataatcctagtactttgggaggccaaggcgggtggatcatttgaggtcaggagtttgagatcagcctggccaatatggtgaaaccctgtctctactaataagtacaaaaattagtcaggtgatagtggcgtgtgcctgtaatctcagttactcgggaggctgaggcaggagaatcccttgagcctgagaggcagaggttgaggtgagctgagattgggctgttgttgagttgtaggagttctttatatattatagatattaaccccttataagatatatgatttgatatttcctctcattctgttggttgccttttcactgtcctttcctttttttgtttttgttttttgtggggcagagttttgatcttttgcccaggctggagtgaagtggtgcaatctcagctcactgcaacctccactccccaggttcaagcgattctccagccttagcctccggagtagctgggattataggcgcccggcaccatgcctggctaattttgtacttttagtagagatggggtttcaccatgttggccaggctggtctcaaactcctgacctcaggtgatccacccgcctcggcctcccaaagtgctaggattacaggcttgagccaccgtgcccagcctgttgtgtccttcgatgcacagaaaagactcttttctctactgaacgcccacagcacccttgtcaaaaatcatttgactagtcagggcacagtggctcacgcctgtaatcccagcactttgggaggccgaggcgagaggactgcttgaggtcaggagttcgagacatgcctgggcaacatggcaaatggcaaaaccccgtctctacacacaatgcaaaagttagctgggcatggtgggtggcgtgtgactaccggctgtctcaactacccaggaggctaaggcgggaggatctcttgagcccaagacgtccagactgcagcgagctttgattgtgccactgaactccagcctgggcgatgacagagcaaggctctgtcaaaaaaaaaaaaaaaaaaaaaaaaaaatcggccgggtgtggtggttcacgcttgtaatcccagcactttggggggccgatgcgggcagaccacgaagtcaagagatcaagaccatcccggccaacatggtgaaacctcgtctctactaaaaatacaaaaattagctgggcgtggtggcgtgcgcctgtagtcccagctactcggaaggctgaggcagaagaatagcttgaatccgggaggcggaggttgcagtgagtcgagatcgcgccactacactccagcctggcgacagactgagaccccgtctcaaaaaaaaaaaaaatcatttgtatatgcgaaggttttgtgccacaaacttttgtggctgttgatacaaacgacatggcctctgccttaaggaagccacagtcgaattaaatagattccgtttcaagtagcatctgtcctgtgtgcttagtgggcactgggcccatgttttcccacattttaccctttaagcttctgatccaaccggtgagatagataggatgatcctctttagtagaggggtaagcttagtcccctgagagcgcggctatggcttatgcgagggtacggacagtcaggatttgaacccaaagttcctggctccatgtgtcatgctacctccagtcagatgttctcacctccaaaacttgggcagaagtgaactgagatgctctctactgagcaactcttcagctccagcatcctatacattaaggagtcactaaaagtcagggtccacgagaaaggtgcagatcggggtgcacagaagagcggagtccaaaacaccactcccagccccagtggacagagtcctcaagtggcagccctgcaactctgagcggatgccgagtcctcaccgggaacccgggcgcggctggtctgtgctattggcgcgggtaggggacgcacagcccaaaaatgcccgcgacaagcttctggggcagttctcgccagtctctctggagggagcctacgggttctgcgacgtttctcgcacttgctccctggcctcgctcccgtttccacccctcccacggaggttttcctttctggtggctccttccttgggtgtccctttggtacgcccccaccctggcggtgagctgcgaggctggcgcccgcgtggccactgcgcatgcggacccggccgcggggcggggccgcgcgaggaggagggtcggggacggaagcgcagagcacggaccccgccccctcgcggccccgctcgtgacgtcgcggggggcgccggcctccgcccggccccgaggggtaagagcgagcggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctgagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggtaagttccccacccccgtacccgctcttccttccaacctagacaggcttttgctgctaatctcatctcacccgtcttcttttgctcacaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggtgagatcagaggctgggtgtggtggctcacgcctgtaatcccaacactttgggaggctaaggtaggtggatcatttgaggtcaggagttcaagaccagcctggccaacatgatgaaacaccatctctactaaaaatacaaaaattagccaggcatggtggcaggcgcctctaatcccaactactcgggaggctgaggaaggagaatcgcttgaacccaggagatggaggttgcagtgaaccgagatcgcaccattgcactccagcctgggtgacagagcaagactctgtctcaaaaaaaaaaaaaaaaaaaatcaggtgcggtggctcatgcctgtaatcccagcactttgggagtccgagaagggcagatcacgaggttaggagttcgagaccagcctggccaacatggtgaaaccccgtctctactagaaatacaaaaattaacctggtggtctggttgcggtggcccacagcggtaatcccagcagtttgggaggccgaggcgggcagatcatgaggtcaggagtttgagtccagcctgaccaacatggtgaaaccccatctctactaaaaatacaaaaattagccgggcatggttgcacgtgcctgtaatcccagctactcaggaggctgaggcaggagaatcacttgaagccaggaggcggaggttgcagtgagccgagatcgtaccactgcactccatcctgggcaacagagcaaaactcggtctcaaaaaaaaaaattagccaggcttggtggtgcaagcctgtagttccagctacttgggaggctgaggcaggagaattgcttgaacccgggaggtggaggttgcagtgagccaagatcgtgccactgtactccagcctgggagacagagcaagactccgtctcaaacaaacaaacaaacaaaaatacaaaaagtagccaggtgtggtggcaggtgcctgtagtcccagctacttgggaggctgaggcaggagaatcgcttgaacctgggaggcggaggttgcaataagcagagatcacaccactgcactctagcctgggcaacagagactctgtcccgccccgcgccccccccaccaccctgcgccaaaaaaaaaaaagtaaggtgagatcacagaggactgtggggtcgggtatcagaacactcagggctgggccctgcctctgacctcaccaatgatgaccttgggcacatccctggactttagtcacttctgtgattagggctttcagtgaacatgctgccgacagggtaggttttctatgaatgctttcttcctctgccagttctgatgttctttgagtctatccttggaggtaggatgaaatgggctaggtttgacctaatgttttctcatcctttagccacctcctcctagaggcccctttttccttagcatagttctgtatgccacaaaagatgcagaaaaaaattagacaccatcaatttccaaagagctatagtcttctgggaaaatgacaagcgatagggagaatgtgaaaatgtcagtggatgccaataatccctgtgtgacatttggccttatctaaaatatgctaagataaagagggatggaagagggtggtattttctgacttctgaggtcctttacaacactatcattctaagattctcctgtgagtatatatgtgtcgggggagtgggtctctgcatgtccagatgtacatgtatgttaacaaaaataaggaatgtgtccgatatatgcagacttgggacaattctttcccattctttttacttttaaatagatatataatagttttattgagatatgattcatgtaccatacaattcacccattgaaagtgtacagttagggccggatgtggtggctcatgcctgtaatcccagcactttgggaggccaaggcaggcagattgcttgagcgcaggtgttcgagaccagcctggacaaaatggcaagactctgtctctactaaaaatacaaaaaaaaaaaaaaaaaaaagccaggcgtggtggtgcacacctgtggtcccagctacttgggaggctaaggtgggaggattgcttatccctgggaggcagggcttgcagtaaacattctcctgcctcagcctcctgagtagctgggattacaggtgctcgccatcacgctcacctaattcccgccccccagcccaaggagtcttgctctgtcacccagactggagggcagtgatgcgatctcagctcactgaacctctgcctcccagtttcaggagattctcctgcctcagtctcccaagtagctgggattacaggcatgtggcaccatgcccagctaatttttgtatttttagtagagatggggtttcaccatgttggccaggctggtcttgaactcctgacctcatgatccgcccgccttggcctcccaaagtgctgggattacaggtgtgagccactgcgcctggccaatttttgtattttttatagagatgtggtctcactatgttgcccaggctagtttcaaactactgggctcaagtgatcctcctgcctcacctcccaaagtgctgggattacaggcatgagctaccgggtctggcgtattacccaattgttttatttactttctcttgattgctagtaaggttgagcctcttatggtttattgtctgtattcatgttgcctgtgaattacctgtttgtttcctttgttcctttttcttttaagttatttgtctttttcttcttgatttgtaggtctttattctagatagtaaaccttttgtcatttaaatatattataggtattttcaatatgttacttgtttttttaacttatctttcattgcatagaagtctttaatttttatgaggttaggtttatcactcttgtcctttattaaaacttttaggttttgtgtctttcataggaagcccttcctcattttaaaattagaaaatattctggccaggcgtggtggctcattcctataatcccagcctttggaaggctgaggcaggtggatcacctgaggtcaggagttcaagactggcctggccaacatgatgaaaccccgtctctactaaaaatacaaaaaattagccaggcatggtcgtgggcacctgtaatcccagctactcacaaggctgaggcaggagaattgcttaaacctaggaggtggaggttgcagtgagctgagattgcaccactgcactccagcctgggcaacaagagtgaaactctgtctcaaaaataataaaataaaataaaataaaataaaatattctgtattttctttaaatacttaagtttttttttagtttgtatagttctttaatacatctgaactttattttataagataacagtttgacgctatgtttttttctacatggaaattttcccaaggccatttactgaggccatcctttccccactaatttaaaatagggtgagaaccttttaatggattttggtaccaagtgagaaactgctttcttaaaaagaatgaactagtttatgcaaactgacatgggcaatgtgtatctgcccatttcactgcagccttgcgagtattagtatggttgttgtattgattgtaatttaagttaatttaaattacaacttaatttgtgtttatattgatacaaagttattttcatttctcagtgatataaataatggtatatggaatactttattgaatagaatcaatgccaaaacacctggtattatagaaagccttaaaaaatgactaggggcaggcgtggtggttcatgcctggaatcccaacattttgggaggtcagggtagcaggatggcttgagcccaggagtttgagtccagcccgggcaatacagtgataccctgtctctacaaaaaaatttttttaaattagccaggtaggtggcacacacttgtagccctgcctactcaggagactgaggtgggaggatcacttgagcctaggaggttgaggctcccgtgagctgggatcgtgccactgcactccaacctgcacgacaaagtgagaccccatctcaaaaaaataaagaaagaaagaaaatacaagaaaagggccgggcacggtggctcacgcctgtaatcccagcactttgggaggccaaggcgggcggatcacgaggtcaggagatcaagaccatcctggctaccacagtgaaaccccgtctctactaaaaatacaaaaaattagctgggcctggtggtgggcacctgtagtcccagctactcgggagactgaggcaggagaatggtgtgaacccgggaggcggagcttgcagtgagccgagattgcgccactgcactccagcctgggtgatagagcgagactccgcctcaaaaaaaaaaaaagaaaatacaagaaaagaagcgtgaagacagaggctcccgcgtcacctctcattttcttccattttctcttctgtgcctttcacaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggtaagagcctcagatgggtcgccagggttttgtagactgcctgctgactactgtatcttgaaggtccctggaaacaattctaccttgtagaaaaagcacaggttttataaccctgccttgggggctgtgtgacgtagaacaagtgtctaaacatctctgagtgtcagcatcctcatctgtaaaacagaaaacatgaccctatctcttaattccatcaaataaggattaaatgagaatgaccgtgaagtgcccagcacattgcctgggacatagagatttgataagtgacagctattgttgtttactattgtctttaaaacattctctctacttcaaaggagttcagaagctataataagaggcaaatgggctaattgctattagagagatgtgagcaaagtgttatgcaaacacagagaaaggagccattaaccctaacttgaacatttatggagagtgcatcacagagaaggtggcatttaccagagagcattgtgcacagtggtttataatgcacaaagtgctctcagggttcattaattcatttgatcttaaaatagccttttgaggtaggtgttattatcccattttacagatgaggaaacaggtttagagaaagggagtgaattgctgcaggccacacaactggttaagtggcagagccagggttgcaacccacaccttctgtcaagtcagaatgatccttgaagaatgaggaagatttggacagggactgcagtagaggaggttcaggagagggggaggtacactccaggcaaaggcaccagcatgcgcacaggcctagagattgaaaagtgttcagccaggtgtcacatctgtaatcccagcactttggaaggccgaagcaaggagaatgcctgaggccaggagttccagaccagcctggagaacatagcaagacctcgtttctttttcgcttttttttttttttttttttttgagacggagtctcactctgttacccaggctggggtgcagtggcacaatctcggctcactgcaagctccacctcacaggttcatgccattctcctgcctcaggctcccgagtagctgggactacaggcgcctgccaccatgcccggctaatttttgtatttttagtagagacagggtttcaccttgttagccaggatgatctcaatctcctgacctcgtgatccacccacctcagcctcccaaagtgctgggattacaggtgtgagccactgcgcctggcgaccccatttcttaaaaaaaacatttttttttttaattagcagggtgtggtggtacacacctatagtcccagctactcaggaggctgaggtgggaggatcctttgatcccaggagtttgaggctgcagtgagccatgattgtgccactgcactccagcctggttgccagagtgagaccctgtctcaagaaggaaaaaaaaagaaagtgttcagcctttgggagcactccatgttgagaggcttaggaaggagaaaaggcaagagagaccacagggatttgatggagaggctctgtgaatgcaggatagagggctatgacctgatgctgaaggccgtgggggccactgaggagttttaaggaggagagagatgtgcttccctggtgctgggtggagaatggctgagtggaggagggccatcagtcaggaggctgctgcacactccactctcacatttgaaaataccccatgaggcacggtggctcacgcctgtaatcccagcactttgggaggccaaggccggtggatcacttgaggtcaggaccagcctggccaacatggtgaaaccccatctctactaaaaatttaaaaattagctggatgttgtggcgggcgtctgtgatcccagctactcaggaggctgaggcaggagaatctctggaacctgggaggcagaggttgtagtgagctgagatcatgccactgcactccagcctgggcaacagagtgagactccgtctcaaataaagaaaaaaagaaaagaccccatgaggagcacaacctgggacttggaatcagagatctggtttccagatctagcactgcttgcactttttttttttttttttttgagatggagtcttgctctatcgcccaggcgggagtgcagtggcgcaatctcagcttactgcaagctccgcctcccaggttcacgccattctcctgcctcagcctcccaagtagctgggactacaggcgcccgccaccatgcccggctaagtttttgtatttttagtagagatggggtttcactgtgttagccaggatggtctcaatctcctgacctcgtgatccacccacctcggcctctcaaagtgctgggattacaggtgtgagccaccgcacccagccacttatacatctttaaactgtggatcataatgaagtttcctatctcatggagttatgatggggtttcaggttgataattgggcaagaaagtagtttttaaaccatcaagacaaatgttcgagcctgggcaacatggtgaaaccccatctctacaaaaaaacacacaaaaaattagctgggcgtggtggcacacacctgtggtcccagctactcaggaggctgaggtgggaagatcgctggagcccaggaggcggaggttgcagtgagccgagattgcactactgcactccagcctgagttacagagtgagaccctgcctcaaaaagaaaaaaaaaaaaaagggccaggcgcggtgtttcacgcctgtaatcccagcactttgggaggccgaggtgggcggatcatgaggtcaggagatcaagaccatcctggctaacacggtgaaaccccgtctctactaaaaatacaaaaaatgagccaggcgtggtggcgggcacctgtagtcccagctacttgggaggctgaggcaggagaatggcgtgaacccaggaggcggagcttgcagtgagctgagatcgcgccactgcactctagcctgggcgacagagcaagactccatctcaaaaaaaaaaaaaaaagacaaatgtcagcttatatgaaaataacattttcccttcagttgctccctagatgtggagagccctctccctcatggaggctccttctatagcccttggactggattaacatgtcctcctcctcctctccctgtacccctccctaggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgaggttctttgctccagtcctgcgggagcagggaatggggtgggggtgggggttgtaaccggggtagagcagatccttggacttttcctcaaagactgctgcttctgagtccccgagaacctcttcaaccacagctctcccttagggactgggaacaatttgacaccgtcagcattcaatatttttctaattactttaacttttttattataaaatagttaacacttatgtagaaaagtccaatagtataaaaggacagcttggcaaattattataaagtggatacttataaataccactgagtagaatattaccagctgtccagaaaccccccatggtcccttccttcctgacaatgccctctctctccctagaaattactgtcctgctttataatgtattgccatgtatgtattcctaaataatatagtttggttttacttatttttgaaactatgtagacagaatcatacacattcttttgtggctgacttctttcaagcaacattgtgattttaagactcataactagttcacatccaagcatttgggtaacaatggtgagttaagagggttcacatttgatgatttgtcctgaatatgaaccatgtttgtcttgcttttgtcctgaaattccaatacccagttttatgatggaaattttgtaaaattcaacttgaaccgctcagaagagtctaactgatgatactcatttactggggacatagtatgtgcccaagaacttgacatgcaccttctgtcttccatttagtcatcgttacctttagaaaaagctgattccgttaacaagatctttggagggaatcagcttcacaaacgtagcagtgggtgggggtcatgttggttaaccagttcacacatcagctcactaaaggaaaaaatatttctgcaaaaaatcttcacttgtcagaggggggtgcatgaaatttgagagccatgtgttatgcatccagctcttgaactggtctcagcttcagctggctgcagtgccctaggaagttactatgggaaaagtggaaatagttgaggcccagggaactgatcaggccagaggaagtggaagctcaagatcaactgtgcttattttgctgatggctgggcctaaatgccccaaccacctacttgggacaggaaatgacaggaccctctcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagcttttttgcccagtggcgtgtatggtgtttattgggggttggattgaggtggggattttagggtaggcaggcttagaagttttgggggactctttcctgttgactctctagtttggacacaggttggcatagggcataggttacttgagctctccccatggttgacttggctttggtaaacacctgtcttgttttcttctacgaaataaaatggataattacagttagttgggcgggtggggtgtcaggtcatggaaatgctgtgacataaatgcactgtgaccttggcaagtcttgcaacctgcagcgcctcaatttccgtaagagatttgaccgattgagttttcccagcgtcgacgcgcaaagattcctcgcacttggaggcccttttccaggttagatggttgctaacctcggagcagtctattttcccgccttttccgcgcccagcagcagcttcctttgcccctcccaacttccaccctgcgcgcagtcgcagatcgccgctgctgtccgtccacccgcgccccctcaaagcttcccctagcaacaagctcgggctcagagcgaaggcggggcgagcgcatgcgctgcagctctgtccaccgccagtcgtgggacagagtgccgggctcctccccttgcaagtctagctcttctccccgcctcctccggcctggggtccgcgtggcggggcgggcgcgcactcgggcttggcggctgccggtctcccaggccgcggcagtgaggagagagggcggggctgagtcctctgcgcccccgccccctttagcccggcgtccctaccgcgcctgcgcgctcccgcccggtctccatcttggaattgggaggaagagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggtgagacacggggtgcaggggcgcgggtccctgtgtctagttctgagaagaaagggtgcgcctttctgagaagctggacttgggtaggccctctcaggatggggaagcccagctgagcgagtggtcagcctctggctagccttgccttctgttgccacccccttccccttcctcttcccttcattgtgtctggttggtgggggacctcaggtgacagggtctctgatgtcaccggcgttcacaccctagggtgcttcagctaatcagatggatttgcacttcagtcttctctccttcactttgcccctcacagccacctctcctccctgatatgtcccgttctcctggctattctgtggttttgattcccatgcctctgattcccatggtgggtctgcttatctgcttttcaggcctggtctggttggatttcttgtccttgcaaggaagtgtgtgtatatgtgtttgtgtgtatgcgtgtgtgtgtgtgcttggaggtgcctggcaatgttttcccccagctgcagttaccttccaacctcttgctgtgatggtgtcaataatctcatccatttgtcaaacgatctgtcttttacaaagtgctttgacagccattctctcatgtgacatccccgcattcaccctgtgggggcctcttttattggcatcttcccattttacagttgagaacgttgaggccgagagaggttgcccaaggtcacacagtggcagaaccagaatttgaactcaagtcctcaatcacatctttccctgatgcatgcctggttcttgccatctcttttcctctgagtttgggctcggccaggggtccctaggagtccaggctggggtgaggtttaagaatggggatgagatgagcttcctttccaggagggctctactcagaagcttttcctgatgggagcctctggcttttgcctctgcctcatggagttttctatccactgtgaccttcatctttaccccaatcccagggtttggcctggattcctgagagggctctctcctgacaaatggtagcactagtggcatcttttaactgttcaagccaagctgttggggtagaatgatcccccaaaggattaaagctttgtggggaccttggaggcagggaaggaaaaatccatatgctgagtgtctgcatggtgttcctaagtatgagatctcattaaaatcttaacaacagctccatgctgtaatccatttcactgaagagaagaccaagaactggaaggaacttatttaaagccctgttgctgtacattgcagacgggatgtactggtagcatagcttaggaacagatagatacgggtttcctcatctgtagaatggagataacattgttcgttttggaaggtggttatgatttagcacagaccttggttattgttcaagtgtttgttgttattatggggaaggggacctgcatgatgttttgccagtgggtggcacccctccgtgtggcctaggttagcattctggggccttgtgttggtaaagaggtcaggaagattcctttggcaagttgagagcacctgcctttgtgtgtgggtgtgtggtgctggtgaggggtgcttggcactgttgctggcagaagggagaaaagggccggctttgagcaacctgcgagctgctgagggctgagcagagagcaatcactcagtctcccaggctattctgagccctctgcaccctgggggcccactggagagtcaggctccctccttgccctccagcttccagttgggctgagacaaaattaacaacacaacaggaaacaatgcatgacagaataaattacatgctaaaattgttaggtgcttttgagtagctagaactctgccccaggagtccagctctgctgaaggctcctttgtgcctaaattctgacaagtgcttaggctggagcctgtcttggaatctccttgagggttttggttctggtatcctgcaggaactttctccgggtgtttggttgggtgccctaggtgctcttcccaatggctggagtggtcaggacaggcttcctgcaagaggggagctgagcttggggtgacagctgagagagtaatggatacaggcctaaccggggagccgaaggtcctgttctctgaccttggagaagtcctttttcttctctgtgcctcagtgacctcacctaggaaatggtgatcatgattctgccctgcctgtttcgaagggctgctctgaaatcatagtgatggaggaccagctttggacaaggcacttaaccttgctgagcctgtttctttatctgtaagataggggaaatcatagtacttgcttcataaggttgtagtgaggactgaatagagataatgcacgtaaggtactcagtaaatgttatttgtaccctgcaaatgtcctgtacctgtgtgtgatgcttatgcagttggacaggacaagtaaggtggcccagagcacagagaggccctcatagccagatgccatttatatccctattcttcccattctagatctccccctgacttttttgagagtgactttgcgggctcctctgggccagtacccacttctaacaatggacggatttccaccgcctccggcctggccatttcctgttctcttccagggtgtgagaggttgagggaggagggggcctcagcgccaaggggaacagaaaggtgcctggaaacagttggggtataggacttatgggacaggacacttggggctctggagtgctggctgggaagcagaatgttttatccttgaggggagatacaggggctatagggaaatgagaacttgttgagcactgaagggggtggtgaggatacttagcttcccagaatcttcctagcagttttagggactccagggacccagcccgcgtgatctggttgccagggcaacttcattttttggagctttgatgttgttcctaatctccccctccccttcctcagcagtgcctcctcctcatcagggaatgaggggaggagatggcagaaacttgatgggtcccttcctctccctgaaggctcaatccttgatctctaagggtcccatttccattcctcaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgtgagttgggtcttgggagggtgtaatagggatggggactcttcctatccctgtggacttcccaacagcccttgcacactactccatcacactggtctttcctgccttctcttgctgggccagcaagtcttcccatgcccggctctcaatggggccttcaacaccttctggtctggtcctctaggcccgggatgtccggaatagtgaggtggtggccatcaagaagatgtcctacagtgggaagcagtccaatgaggtgggccaggtgcaatacagccaggttggggacaggggactcctgtctcaagatgcaagctgggtaacctctgcctaccctgaccccctagaaatggcaagacatcatcaaggaggtgcggttcttacagaagctccggcatcccaacaccattcagtaccggggctgttacctgagggagcacacggcttgggtgagctggtgccagattctggcctgatctttactcctattcatgcccgtccttatcgtagtccagtctcttaggtggtccctgttcgtggtgctgttgtgggatcttgggaaggaggaagtctcttttgaccgctttagtcctcagacatacccactgagcaaaagcctggctcagtgacacaggctgttagcaggtgggacaggtcactgtgggctggagaaggtggagattgaatgggagtttgaagggattcagatgggcagtggtgaatgtcttgggcccagactctagaaactctcccaccaccccctcattgtctccagttgcgcttcctccctgtcatcaccccggggacatagcttgagtacaggacagtcaaggaagctctgttttgagtccctgcccaggagactctgatctctgacccttgtctcttccttagctggtaatggagtattgcctgggctcagcttctgaccttctagaaggtaagtgactgataggccaataagtggagaagggagaagagcaggggagccatagggaagggttaaggggagtttattccagtcccacccttgcgctccctcgggttgatgttcttcctcactctccagtgcacaagaaaccccttcaggaggtagagatcgcagctgtgacccacggggcgcttcagggcctggcatatctgcactcccacaacatgatccataggtacaagcagcaccggcagtgcctgggaggggagtgctatctgcaccacctgtcacttagctgggctgcccctgcctagctttcttgagacacatgtctcatccctgtactttgcctctggcagggatgtgaaggctggaaacatcctgctgtcagagccagggttagtgaagctaggggactttggttctgcgtccatcatggcacctgccaactccttcgtgggcaccccatactggtgagtgagtgagtggtggtgagtggagagacctcccagggatgttgggagtaggagtgacagggtctcggcgggtgatttgcctctctctcctgaccattctcctaggatggcacccgaggtgatcctggccatggatgaggggcagtacgatggcaaagtggacgtctggtccttggggataacctgcatcgagctgggtaagaacatcctccctgttccctcatcatcttttccattctttcctgttagttcccagactccggactacccccttctcctagggatgggatcccaggcctccaagttcctgtccgttgtgactctaccctggagcccaatacaggcagctggcaaattctgccagctcttaggcctagagattttgtagcattcatctcttcctgtccactaccctggttctgaatcttttcttagtgcccaccatgtgctgtgccatggactgtgattctggagggatagcagtgaatgaaaatcctgccctcatggaacttacatttgatttagggaaaccaggcaggcatgttttctttcaatgtgatgaacgctgtgtggagaagttacaggagcggttcaaatgtaaaacaggggacttgacctagtttaggggctgaagaaggcctccttgtaggagaatattgaagccaacctgcaagataaataatagctgtttgcagaatgtagggaagagctttccaggcagagagaacagcatgtgagaggcctagaggtaagtgcaggcctggggaactgggactagcttcagttatttggaacctagcatgtaatgcagagaatattgaaggataaggccagagagttaggtccaagtgagttcctaaggccttgaagccatgccaaggttctcatctctgtcagccagcactattgaaacaattctttaatgaggtaggtaacctttataaggcttccaacacaatgccaggcacaaaacagttgcctaagagttgctgttagtttctcttatcaacagcctcctgcagtgatctctccagtctcttctcccttccagtctgtcttaagtactgatgccagagaggtctgcctaagctcagtgctgtcatttcactccctgtttggagccatgagtggccccctgttgccttcaagactgaagccatccccatccttcctcccaccaacctagaggctttgcttcgtaaatgctggccctttccttcatgggctccaccctctgagtgtgtcatgaactcttccacttccttgccttggttcgtattgggtcctctgcccgaggtcagagatttggacgagcccttctcctccatcttcacagtctccatttaccattagatgccaggcccagacagttgatgaaaaatgtaagaaacggacccaagtataagaaaaagctagatctgtccattttatttctagtttttggaagagatgtggatacagagaaatattactctactattgaaaaaaatatatatcagtctgattataaatgtcaactcatactaagtcaatatcagggaagcagtgtggagaaggatgtggcaaactggagattgctgtttccatagaaagagggcagctaatgcttatctccagaccattgttatgcagtaatgtagactccatttcaccagatttaattcttaaggagaaactggaaacttgtattattatttgattattacttttggcagttaattttaaaaatcaccgtttaggccaaaacaacatgacatttgtctgggctacaagggactcttagcgactcttagcttgcacttacctttctaatctcagggctttttacaaagcccttctctgaattccctgaagatatgctagcttgaaggctcactgcatactctcaacttcccagccacttccctgtttccctcttataccagttaatactttgatgttattttttcagtcctatttaatcttttagactggaggttccttgagggtggggcctaattcttgtttttatcttccccatagcaattatcaagttatctgctccctttggcacctaagaaatattagttggggtgataactgaatggctgtccttctgccttcgttactgcttttgtggatgttattttctttgacccctattccacccgtgtgcagtggagaggatgggtgttgtattttacagaggaaggaattaactgagacgcaacaggatgatgggaacttctcaaggtcatgtggcaaggaagtcaaggaattggggtttgaacccaagtcgtctcagttccattccattgtcctctaccccctgccacctctcaccttcttccctttcacctttttctgtagctgaacggaaaccaccgctctttaacatgaatgcgatgagtgccttataccacattgcacagaacgaatcccccgtgctccagtcaggacactggtgaggactgagattccgaatctgggcccaggcgttaggccatggggtatggatgcctgactcatgccttccccacccctctcccaccctcctgtgactttcaggtctgagtacttccggaattttgtcgactcctgtcttcagaaaatccctcaagacagaccaacctcagaggttctcctgaaggtgagggcctgctggcctagcattctcctggaactgtagcttgttacagccacaagaacccccagggaaattagtggttcccagttcctcctccaccaagagcttcgttgatgaattcccaccccatccccaatgcctagtggactctgtgttttacaagattttgtctaccagactgccttaatttattaagtaataaactgttttcccttcttttattaatcaaagatttatataattgccagccagagcttctggtcagcatgtgataaccagggttgccccactgatctgatgtaatgcaagccaaaagcctgtgtagccttatcatgggtaaatgtatgatttcccttaggtgttttttgaattatcaaaaatggaggggccccattcccttcacagacccatgggggcctgaggagccgtagttggaaacttcagattatgtagttggacccacttgttttataattgtaggatactgtatgaagcccagaggggcctcatgacatgtccaaggtcacatagccctttagtagaggagctggacgagaatccagttctcctgactgtccctgcctgtcagccatgcttagaggaagaagagtctgtctggggagtaggtactgggtggtacagaaaattgtgagagaagggcttgggataaggccagcatcaacccgtggtgggcgtgggccccagaagagtgcctcaggcctgagggaatgccaagggctgtgggttgtggggggaaggggagttggcagcagacctcagtgccctcttcccccagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggtgacccagcttgccctaacacccctctttataccccatgtgtgcctgccccctgcagttgcttggccccttccccagccctactcacaccaccatcttcccatgctacctccatgcatatgccccagggcttccccttccctgtccagcagcctacgccctgttcgcaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccggtacacagctcacccttgggggacccgagccacctgctctagaactgcctgggtcttcgccctccttccctaagtgcagcactcctctgagtctgattggctgtcctcaggtagctctctttggacccagtggcctctgagccttgggtgttccttctatctccctctagggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtgagtgtagccatcctcactcagcctgctcgctgtctgttttttaagtctttttaagtctagaaatgatttcctccctgtggcatgggattgagtctggattctaccctcattttctgttgctggctcctgcctgctccccttaaccctcctgcttccctcctcttcccagtggactgttttggtcatatggcccaatctgggtgtttctagcttggcaaactcttactccgtttttgtggcctgacttaactgacatctcctgggttgccttcccaggctcctctggtgagtcagatgcttcacagttgtgtgctggggaagcccagtgctgggggagccctgtgcctgtggagccctgtgctgggggtgtccagtgctggggagccctgtgccgggggtgccctgtgcttgggtggtcctgaacagcatcatgataggtttgccagattctgtgccccagagggcagggatggtgttcagatatctgtctcatgccagcagttagctctcaggcttacacacaggcctgtgttaaccctcccagcccccctgggaggggaagggtaagatcccattggagaaatgaggcacctgtggctcagaggggccacttgccccagtgcctttggtggctctctgctcctgtaagcaggcccttagtcctctcctaaaatcaactcatggcagtctttctcagttcacaggaaaaagtgtttaggcttttcataaaacatagtttttcatctatgtttttagatcacgttcctgctgagctgcatttgagcgtcaacaatccccttagaggccactgattaagtctagtatgttcttatggcctctgcttggtgctggttgtgttccaacaattcttcagatcccatggtgttgtgcggtactgtgctgagaggtcttgactgccaggggcttggctgccgggactagtttgagagccactcatagagtcaattgagaatgagacctgagatcagactttggatgaaggtgtccaagcccagtgttcttgttattccagcatcttgtggccccgatcccacctcaatacctggggagtgataggccgaccatgtttgctgaaggggaaggaagccaacacttattagatagagtccgaacttaccccacagcccctatgaggaggtattatttccccatttaacagatgagggaactggtgctttgagaagttaacttacttgagatcacatgcttggtaagtggcaaagctgggatttgatcccaggtatgtctgactcactgtttcaaattagtatggattgttcctacttttgtgccaggccctgtgctcgccaccttttatcattcggccacaccaacttgtgatgtagataatatcaccattatccagttgaggaaacaggctagagtggccgtgtgtgaggaaggtgttaaatgagaatgaaacccatgagttgaaaacccatgctcttccccacggaagaccccttgtgttaattaactaggggccaggctgagccccagctctcaccctctctccttccccaggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggtgagctagggctgcttgggggcggagccgatggcgagccaggtgggtcctgaccctgcttccctctgcactcgcccaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggtaggcatcccaatctctgttcccctcccgctcactcgtggatcccagggacccacccttttccattttcctcattcttgtcttctttctccttggccctcgagtgttacagttcagctttgcttcagtgccccttttacttctcatccccaacagaccctgccagaatttccttaggcctcttttcccaggccagggaggagcttgcctcccctacaccctcatctcctgccatccccagctccctctgccaaggagccctggcccctcacttccttgatactgaccaggccctgggccctgtgtttcttccgccatccccagctccctctgccaaggagccctggcctctcacttccttgatactgaccaggccccgggccctgcatttcttctgcctcaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtgcctttggcccaggctgcctctgtctgctttgtcctgccgcctagcctccccggtatgcccccaggctgaccctcggcccggctccatgacctcttcaccccatctccgttatctcagccccctcactcctccagcctcatgctctctgccttcatagcttcattgcaccatgaccaccaccggctctggggtctgggcccctgtagaacttcaccgaacttcttggtcccacagagcgcctgtttgcgggttccttccagaggtcttagtttccaggcccttggtctcctcatcccttgccttttctcccaaccatggctgcaggggaccaaattgctctcctgcatcaggcattaccctagtgggttgggggacggggctgcagaccctccacagtagggggtgctgagctgggggcaaccaggcggagtatgaaggctgtggcagcaggattgagtgtgggcctggagtgggagctgagtgtgtgaggggccgggctggaatgcggatctggtcagggtggtagctgctggccggttgaacttgtcaggccctttctggccacctcctttgcccctttctcctctgcggcccaaaatggggcagccccttcttacccatttctcagctcggtgcttctcctccttccctgccttcctccctgagctgctggacctgggacttcctgtgtctgtccttagtcgtgttgctttcttcatgggtgttttgtgtgactggttcttctcgcttgttctcgtgcacgttctcatatttgctcacgtgcttctgtctctaggtcacagtctctccctctttgcctggtcagagcttccaagatcctcagttccctgtccagtaactccgatgttctttctcgtgggtatcgcacccaactccgtgcacgtgctcttggaacctcttgtcttctctgcatctcttgcccatcgagaccttcctgatctctctcaacacgatcccacctctccatgtctgtctgtctgtatacagctccccccaccccctctgtctaacatgttttctgtttctctccctctccctgtctctgcttctgtctcctctcctcttctctctcttctccccatttcccctggttgttcctcctcttcctcttcctcctcttcctcctcctcttccccgctgcccccatctccccttgatccgtccactgcatagtctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcggtgaggcctggggtccagggagggagtgcgctagaggccaggctctgtactttgctttagagaaatggacggtgcagggcatgcacagagctggggcttttttacttgggaaactcacatactctccctctgttcgtgttctccacaatgatttatttcatattctcctcagtggttttattctttctcttagtattttcttaaggtcttgacaaagccatgtgcctattcccaagaaccaccaaggaaaagagtggctattatttttttcctgggcctgagttagtttaatgggtaaacagggtgcagattaaagtgagtgtggccctcaagcccatttactcagacttctggaggattttgaaagttgctgttctaaaaaaatgatcacacctaacactggaatgggccacttaaaatgtgcggagagggtggagagtggaaacgccccacccaaggctgttctctcacccagtcccacctctcccaggtaacttgttaataattaactgtattttgtgttttttcagtgcacattttgaaaaattatatgaattttaaacacagatggaatcatactttacatttactttctgtaacttcttttttccacttaatatttcttggacatcttcccctgtcagtacacctgtctcattttttttacagcatagaattttccatggtatggctgtaccataatttatttaacccatcccttattggtggacatttaggttgtttccagtattttgctatcacaacgcttccgtgaacacctcgagcacatgtgcaagtatacctgggggatagattctgcagtgtaattgctgtgccacagggtatgaccatcttccattctgatagatgttgagaccgctgcttcttgaaaccttagggcccaggcctacctggggcaggggaggatagtgggggtgggggaggagatccctacaactggttgttcatcttccccagctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtaaggggcccagcctccaggactggggagggagggtgggctcctgcccccgactctaacctctgttccggatgccccaggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgataggtgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacagatctcaggactcacccttctgtctttggtgtgcgtgaaggactgctcagtggccactgaatagtactgcttgtgttttataaagagaatttattgggctgtgtatctaaacatttcagtgattttaatgactttaggtgtgaccagatctcggatctcaaaggtggtcttcaaccccttgacctctaattcgttttctttgctttgacttcaaagattcttaggtttgcctcccacacagaccccaggcagctccatgctcacgaatcttcccgcaagcctcagcagccagagttcagtggagacctcatgtgactgcagaggctgggcctgtagccagaggcctagagggctaggactggcccaggaggtatgggcttttccccacccctttgaggctaacagcccatggacaaagtggctgtttgcataagggagaaggcttaagcactggctgccctcaagtcattctatccctctcccaagtgggcattaggttatcagactaggctaaaagcagaggggccacggggtaggcgggcagcacaggagccacacacccttctccaaaagggtctggtggctgttggatgacagggtctggaggcagggacttcttccaggaacccgggggaaattaaagggaaccaggccaggggaggaggtggaggcagtgactactgctcagtttcctggcccaaaatacaggaggtgagaatgggggaccaaatttgatgaggtgattaaaaacactcctttattgagtcttaaaaaataaacaccttaaagggacagcgtgaagctgagaagtagcatcccaacagcttgtgtccttgggagctgcagtcttctctgaaggaagctgcttctgttccacagacacagggcaaggggtgctatgtatgctttgtacatgtatcaagggtccctcctgggggtggcagagctcagttactctcgccatcactgctgatgatgccacgcatatgtgaccagtctgggggtgcgggacggggccgctcttcatctgagtccagggtccgtcggtacagctcccctgggggtgctgcttctcctaaagggttccaggctgtacgtctgcgtggccggcctaggggaaaggggaaacgagagatcagatgtctgagaaggtccaaccccacctatctgctcctgggcagtgagaggaaaccccttacccgagccactgatgatgttcgcaacatccaaggaggccacctcagctgcctcctccctctgctccttcagggcccgacacttccctagggaaggggtacctggggcagaagaagctggtgattctctcctccccagcaggaaggccctctcctgcagcccccagggcacgccgggcctcacccttcatgcctagcgcttccagttctgcccggaggatactcaggcgctccttgtgtgagcaacaggagcccaacagcttcttgtagtttcgatgggcaccacaggcccgaatgtagcgcttcagcctcatcacagccgggtggtcctctccacggcgacctgagccagcctagcaaggaaagagcagctgaaggccaagcctgctgggcctgaggcagggtctccctcttccctaatagtggcctcccacccctcctcaccctcaccttccctcctttggcctctggacttccatctgaggaggaagaggagcttcgtgtcctgcctttcctggagctcttcttggaagagcggttcttcctctccccctgggggcctccccctgcctcgctgtcacttacctccctctccaagtcactttcctcaccactggtgctgcccagtctggccatctttctagagcctttagctgtgggttcccccttcccactgtcttcctcgtcctcgctgcttccactcaacctcttcccacccttaagctgggtcctgtcctcactcttcctctgcactgggggttctctatctctcccactgtcatccccactgctggctgcctctttctgctcttcctcgctgtctgagtctcccaagagcctctttgcctggcttttctgcttacagctcctctcctccctagctgactttctccggccattgctcctggttctgggtttccaatcccccttttcctcatcctcttctttctcttcctcctccacttcctcctctctctgctctttcttctgggctaggatctcctcttcactctcctgttcactttccttcaggcttttagttcctttatttccctccaccttctttgctgtcctctgaacgggttctgcctcgctctcctcactttcttccctggcctgcttcctactgactgaggccttgcctggtgcctgcttctttaccacaggtttcttcctagtcttccccttgtaccccttttcctcctcctcactgctctcctctcccctctgtgcgggcaggtccctctgccgttcctcatcactgctctcctcaactgcctttgaggctcgccttggattctcctctttggctgggctgacttctgctgccaccccattctttgctgggggtccaaagtagtctgggctggaggcttcagagccggactctggaatatggagaggagagagggttgagacaggctcctcctgtcccttctcccttcacttcggataggttgcctcgagccctgccctgacagttggaggggcagcaggaaacagctatctgtacttgctgttcccggttcctgactcactagccttgctccctcatctaacgcctggggacataagagatgcgcagtgaatgcttcttgagtgaaccaacgatgcagaaggcccccacagcagggaggaagcactaacccgactctgaattgaagcggaacctttttctctccgggtcgctacaaggggtgggaggcctcttgcccttcttggtaaggtccagtttgtcttccctggaagcggcttcatccacctgtgtgtgcgccaagagggcaaactatgcaccaaggctgcgctcaccgcgccccgtcaggcccctcctcctcagcagcaagccccgcctccgcctcccgcggcccaggctccggcccggcacacctgcatcttcagcagctcctcctccaccagccgcttcagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgtgagtgctgccgcgggaaggctgtgggggatgaggcctggcgcggacaagatctcagtttacccaggtgtaaagtgggtggggcgagcggccgctggttccggggcccttcacggaggaccgttggcccagcgcaccccttgcccgtgatacaggagcacgagtgcttccaggaggagctgaggaaagcgcaaaggaaattactgaaggtgtcccgggacaagaggtgaggcacgttgcaggggcggagggcgatgtgcttcctaggaaatctacattcggaccccatccccgagtagggccacaagtgcatgggctctttcaagtatccgatgggccagctgggagggacaggtacccaggaggacattgctgcgctggaaaatcactgtccgtgtctccttccctcccctcagtttcctcctagaccgacttctgcagtacgagaacgtggatgaagactcttcgggtgagcaaggtcttcaaaaattggtggagagcatggttcctggtacttagcaagcttcctgggcccccgccttttaggcagtggtggctgatgcagcccccagtggtccttaagcctagttgcttgccttccacctccaccgttctttcattcaggcacttactgagcacctattgtgtttcaggcactgtgcttggcacaggggatacagcagaggcagagataggcaaagcccttggcctcttgtaatttatattctagttgggaagaataagtaaatgaagacaatagactagaattttaggtcataggaaggacttgaaggtaatgaaaacagttatgcggtaatgattatagtagaacaggggttgatgaattgtttctgcaaagggccagatggtaagtaagctttttgcaacatacaatctttgaagcacctactgaactctgccattgtagtagcagccgtaccccataggcaaatacatgagtatggctatgtttctataaaactttataggcactgaaatttgaatttcatatttttccatatgaaaaatttttctttagttttttttttttccaaccgtttaaaagcttaaaagccattcttggccaggtgcagtggcccacgcctgtaatcccaacactttgggaggccgaggtgggcggatcacaaggtcgggagttcaagaccagcctgaccaacatggtgaaacctcgtctctactaaagatacaaaaattagtcgggtgtggtggcgtgcacctgtaatcccagctactggggaggctgaggcaggagaatcatttgaaccctggaggcagaggttgcagtgagccgagatcgctgccactgcattccagcctgggtgacagggcgagactccgtctcaaaaaaaaaaaaaaacgcccttcttagcttgcagaccacacaagcaggcagcaggcaacctctgaatggagtactcaagaaaggcctttcacagagtgacatttgagttgggaccagagaagaaaccagccttccatcctgggcaacatagtgagaccccatctcaattaaaaaaaaattagccatgtatagtggtgtatacatgtggtcccagctacttgggaggcagaaccaggaggatcccttgcctgaaaggtcaaggctgcagtgagccatgatagcaccgctgtgctccagcctgggtgacagagcaagactgtctcaaaagaaagaaaccccatcctggctaacacagtgaaaccctgtctctactaaaaatacaaaaagttagccggggatgttggtgggcacctgtagtcccagttactcgggaggctgaggcagaagaatggcgtgaacctgggaggtggagcttgcagtgagctgagattgcactactgcagtccagcctgggcaacagagccagactccatctcaaaaaaaaaaaaaaaacaaaaaccaatcttgtgaagaagtgggctagagctgtcccggcagaataatataaatgcagctaccctgaggtaagaacaggtcaggcttggttgaagagcagaggcatgaaagagagagaacactgttttcgtccttttatttgaatattgtctgcagttaactatattttacatcataaccagggccccacatgttaaacaaaacaaagtttaacgaaacatttttaagatcactgtatccaattcatcctgacactttttagactgcttttttccccttcttttaatgctggttgcaaaccaataaattgatttcatgacccactaatggcttgagacccacagtttgaaaaagccctaaggtaggcatttgtgggcctcttcctgggtgaggccctcgtaagccatgtcacgtagaatcacctctctccgtggtgcctttaaacattggtctgggccgggcacggtggctcacgcttgtaatcccagcactttgggaggccgaggcaggcagatcacgaggtcaggagatcgagaccgtcctggctaacatggtgaaaccccgtctctactaaaaatacataaaattagctgggtgtggtggcgggcgcctgtagtcccagctactcaggaggctgaggcagaagaatggtgtgaacccgggaggcggagcttgcagtgagccgagattacgccactgcactccagcctgggcaacagagcaagactccgtctcaaaaaaaaaaaaaagcacattggtctgaggcagggattggcatgtggcagccagccacgttttaggacgtagtgttttgtcagaacgcatgatacccatttgcttgttattataggaggattgtagataaggttggggaaataggcaggggcccactcaggtaggtcatagtaggagatttggcttttattgtagcctctcatcccctgcctcttccttccctaggggcttccagttaacatcctgtttgaggggaattcagggcaggaggtgggagagaacccagcatgttcatggccagagtgggttgcatctgaggaggaagagccagcgatgcgagccccactcccgtcctggaggcccacgccctggccagggagacactcgcaaacgacgcttttcagcacagtgtgagggcagccatgacgagagtagagcgttccaggagagcctgcagttaactgggcttgagggattctggaagacttcacagaggaggtggcatttaatctgcttcttaaagggtctgtctgagcagagacattggtaacggcttctataggtgtagcagtcgtttgttcgatgaaagatggcccttctaggcagaggcactgaactaggaaatacatttcttttttgacgaaataggtcagtgtgctttaaagaatacagttacgttagttgaccagaaaggtacattgaagccagattaagcagcaccatgaattcatgcaggtagtgggtgatgtcatcaggaaggatgtgaccaggtttgttttaggtcactctggggttgggggtggacagtgggtggcacggtgaggtgagactgcttagcaggtgattttgacgtgctggtggcctgacctgtgttagttggtgtggggagcagtggatgaaggggaggacttcaggggtagatgaacaggaccctggttatggggagtggggcagaggcaggagttgaagactgctcagctcagaggcaaggaaccagtggcatcaaacagccaaggagtcacagacctggcttggagtcttagcctcacaccttactttctgagcctcggtgacctcatgtgacaagtggaggtgctgcccttcccatccttccttggatctgatgacaaggagaggtggtgagtgggaaagagcctggcaccctggccatgcgtggcaggtgtgttacggaggaaccagagcgggcggggggctggggaggctggagaggctatgggcctccctgggacagctcgagtgtgtggtgcatgcgtgtgcccaccagctggtgagtcagattcccccggggcccttctgttaggttttggtttgtttcatttttttgaggcagggtcttgctctgtcacccaggctggcgtgcagtgttaaaatcacagctcactgcagtctcaatctccgagtagttctcctgcctcagcctcctgagtagctgggactacaagcacacgccaccatgctcggataattgtttttgtttttaatagagatgaggtcttgctaggttgtccaggctgctcttgaactcctggcctcaagcgatctggccacctcagcctctcacagtgctgggattccaggcgtgagcccccgcacctggtcttccagtgcccttctgtagtgtagaggaggttatacctttctgggatggactgggatccccccatccccactgaccagctgtccccatcacagactcagatgccactgcatcatcagataacagcgagacggaggggacacccaagttgtctgacacaccggcccctaagaggtgagaagaagatgcattcctctcgctggggagggtcaggtggggcgcctgggctcctagccacatctgacctcgccctgtcctttctccaggaagagaagccctccgctggggggcgccccctctccctccagcctctccctgcctccttcaacagggtttccccttcaggcctccggggtcccctccccatacctgagctcggtgagttggggtcagggatgggaagtgcttgggagtaaggtgggcgtcatttgggcagaagggctgggcctcggggcaaggccagcccaactttggggacatctgtctgggtgtggcccaagtgtcccgtggagggtgtgagtcggggctgcccccttctctctggtataggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaaggtaccctgacgtgggggtgctagggaggggcaggacggcaggaggacagtcacctgagggaggctgaaggcgggggcctgtcagagaaccatgaacagttaatttggggacccagtcagcacttagcactgaggggtggatcacagaagtctcggcttacaggcttgtatggagacaaatcagggcagaaccagccttggaggacccggtgtgcagatgccagggatcccgccctttcatggctgcagtgtagcggggccaggctcattttcccaggggggcgtgttgtgtgatgccaggtagccccagaccgggtcaggattatgggatctagagtcaagtcaagactgcctgttagaaaccacgtggccttgagcaggtctctgctaccctctaggcctcctaggcttggcacctatagggcgagtggtcctactcgatgtgaccagcaagcgcccctggagcgcctcctgttacacggcagtgcacaaagcagaccagtgcctgccctcacagagctcacagtctagcaagataggcagaaaacacaccagaaaagtaggtacttgtggagaagaacagagcgaggtccagagcatggggacgccagggggacgaggctgacacttagggcccagcagtctgggatgttcttgatcagagacttacaggaaatggcagcaagctgtgtggctcctgggcagtgtttctgtcgggcagagtctgtgtttgggagaaaagtaagcagggaattgggtcccggagcaggtcagagggggagctcatgaggtgccagtgtgcaggattcgctgtgaatgaagccttggagacagcagttccctggcggggcgcaggttgcaggtgtggagggggagtgatctaattgcatcttaacaaaattgcagacactggtggtcagagaacagactgagcggtggagtgagttgggacgggagtgaggaggccaccacggtaaaccaggccaagggcagagggtccagagggagctgcggacccatttcagagaatgagcatgggagttcctggaggacctggtgtgggctgtgcgggagagaggccaggatgcctccagggctttagtctgagcacgagtggagtctccctccctggagatgggagggctgtgggaccacaggcttggaggaaaactgagtctggccgcggatgtgtcagatgccatctggaaaggcagctagatagcggcccgtgaggggctgcgcatttggaagccgccaggctggcggtagatgcaagccttgggagagatggggatgggctgaggggcagagcggagtggggaccaactgggcggctcccagggttctggagccagaagcagaatgagaggccgcatttgcggtggtctggagtacaggatctggagctctaatcccaactctgccgttttctccgtgtgaccttggccctgtgaggcttcacctcttgagcctgagaagcagaggtgacagtactggccctggttcttagcaggggggtggcgggcagggtagggggtggcgcagcactggggggcactttgaggctttctggctgggtgctgagtcctgaagcagagtcatgtccgggagcaaagttgtagacattctggagagaaggtttgagagggtggcccaggtccatggctgtcgggggaggtggggagaagccaggaaaggcctcagcaaggagaacgtgtaagcccagggtgagtggatttggatattcctggctgaagccatagtgggaagggagacagggccacagggaaagcactgcctgggccagagcaggagtggtaagaaattggcaagaagaaccgggtggggtggggtcatggaaggcctggacagtggcctgaagtgggaatttgtctgttactgtcaggggagcgggagtccctgaagggccaggggagtgaggagatggaaggaagggagtccaagcagaggaaggatagctgtgaagacagaagcaggttggttctgtcaggcctgagttggacttggccagctttgaatcccagctcttccagtgctcaccatgcgacctcagcgttgtcatttcactctttaagccacagctctctttctccattcagtggcggcattgtgcggagaatgtgagtgaagggatgaaaatcgctcggcccgtgcctggcccctagtaagccacagagaaatgtgagccgctgccagtcaggctgagaggacgccactgaggaagtccaggccagggtgggacatgctgcgcacagtggggaaggagaggaggtggccagaggaggggatggtcctttccagtcatacacgcatgtctgcttgtgtgtgtacatgtgggggcctggtgcagggcgtgggggtgctgttcagagttggaccccccatcatccatcctgccagcctcctataccctgaggcctgacccaccctggcccccacaccaccccagcagcggagatgagggtaagtgagggctccttaggaagcagagaggaggccacagggccaaatgtgacactcagaagggccactggagaccacgcatggcgtttcctgccagcccactcagcatctagcccagggccagactggacactgccccgcaggacccagcaggcctaagcctcaggacctccatgtccacaccaggttcagcctcctctgctggcacgtgacttctccccgtttcccgccccccagtgtcctgaggctgggagggcattaacagaaaccacctgacacacagcaggtgcccagtttgtgcccacagacaaagcacggggactgcagaggagacccacagagctctctagggagggtttgtgaggacctggcagcgggggggagctgaagggttgagcagggcagaggccacttcccaccctcagaggacaaagcaggacttctgacaaatagagcaggatgcccagggggaggggctgcctgtcgtcccgcaggcggcactcccgccccgaggccccgagtggcacggtgacgcgctcaggtctgtgttttagagcgcgcgctctggctgccgtgcggaggagctggatctgggagaggctgcgggcagggagtccagttaggaggctgggaccgcagcccaggtgagctaagaggagggctgggcctaggccacagctgccgggaccccgaggaggggcccatccaagacataatacaagcttcttgggggcagataagccgctggggctcctggctcaggcagcctgcaataccctccaccgaaccagtgagtgccgcagaagagggagaggaggagtagggagaggaagctggtggcaggtggcacctccggggccggcaggcaggcaagcactccaggccgactccgcctctggcttaacccctgtctcagggcagcccaggcgcctccctggagagggcaggtgcccgggcctttccctcccggtttcctgtgagacacccccatcccctcatctcacctctatcaccacccccaggcacttgctggtttgaggctctcgaggggctgaggggggcaggccctgagtgcagcatgggttggcccagctgtgcccagggcctcttccccctccccagagctgccctggggggcaaagcctagtctcctgaggccccagtgcctccctgactagtccccctgtgtttcttccccctgctgcagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgggtttgttttttgtcctttttttttgagacattctcctcctctgaacctcccctaatccgacctcctccctgttgggggagagggacggggcagcgtggagaggcaggagtgaggagcgcgggggcctggggccgggctctgagcactgcccgggtgtgcagatgatggggggtttgcatatttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagcaggtgggcagggtcagggccacctccctgccacttgcccgccctcaacacccgcagccagctcctccctcaccaatgaagtcattggatttgccaatgtcatagtcccagacggtgacttccagggtcttggtggccagagtggagagctctatctcgtagaaaaactcctagggacaaggccggccacccgttcgtgagccagctccccagcccctccctggcctccctccatgtcccgtcccctcctgggtacctcgttaaattctgggttgagagtcttcttcttcacacacgtcttatgcttggatttcttgtccacatcgggcctcaggtacctgggggtggggtggagggagacgaactgaggggtgagggacaggccaggcccaactcaggccagggcaggctccctggggaggagagggtcagagcaagggctcacgtcttgacgtaggggtccgagtaaccgttgacgtccatggcagccagatgggcgcagcgcaagatgcctaccagcagtccccggcgccgcgagctgtagctgagactcagcaggatgcggccacgctcctccagcagcccctgcccctgctccgcctgctccaactgcggggcacagactcagggtcagcctgggcccctgcagcctcccacccacatgcatccccatccccatgaggtgcctcacctccttcagataacaggagatgcccctcagcgccgctgacatggaagagggggacgccagctgagggggcaaagagaaggttctggaagcctggcctccccagggccccctcccctggcgcccctgcagcccccacacagaccgggacctggcgctcgaggcagatgttaaaatgcttcttctgcgaaggcttgaggcggcggaggggcacgcggatctccccaataaactcattgtgactcagcttgtcctcatcacagacggcgatcctggtcgggaactgcagtgtcagggcccctggggtacctgagccccgttccggggtgtaggaagggccttggaccagcccagctctgccctaaacactacgtctcatctggaagacaggctggcacttgagaaggacaagcagatttgcccattcctctgtccctccctctgcagccacccggctgtccctggtccatcaggacatgctcagccattgtgggaagccctcagaaatcttggagcacgctgctcactgcctccattcagggcctgggggcaggagccgaacaccacggtggatgtggccatagacacaggccgtgagagctagaagggccttggagccttgggcagccagaccagtaccccacgcctcctcgggaacccccgtccttttcctgcatgcagcagagagccagccccgcagggactcactaagaaatgattgctttccagccacctgtcctcctgcagtccctgccctgcctccgcagtgacccactaccaggctgggcatctgtggcatggaggatgggcagatcccagccctgccacttctgagccacctgtgtgaccttgggcaagtcacttgatcaccctatgcctcaattcccatctgtaaatggagatagtcaagggaaagaaagaaatgtgaaaatgctaagcctgggctgggccctggtgagcgctcattttttggtctcattctggttttggcctctggcctcccctccattccacccgaatagctgaaaccaaggtggcctctctgctgcacagccctgaccatcagggaaggtcccagctgcaaatccaagcacaaaggcagaggtctctccagagcctgggtttcgctgcccgccacctgacttgagggagtactctccctacatctccatctcctaggatgacggagcaagttccctgtccctgaagacttcactccttaagagattttaggggaactcaaggcacggaaggggcagaccaaagctgcagaggtctggcttaagccaagggctctgagaaggggtctcggcaacccaggaacgtttttgggagggggcagagcttggactgaacctcagatgagcggaatttaggctggcaggaaggagctttccagatagaaaacaacaggaaaagttcaggagttgtggaactggccagttggaagaagggagtcctctgtttgaggggcagaagatacttttgttttgtttttgagatggagtctccatcacccaggctggagtgcagtggtgcgatctcggctcactgcaacctctgcctcccgggttcaagtgatcctcctgcctcagcctctcgagtagctgggatttacaggtacatgccaccacgcccggctaatttttgtatttttagtagagacgggggtttcaccaagttggccaggctggtcttgaactcctgacctcaagtgatccgcccacctcggcctcccaaagtgctgggattacaggtgtgagccaccacacctggcaggcaggagatattgaggggcaggaatggcagggaagaattttggcctgctgccaaaggggctagggagccgctgatggttcttgagcatcagagaggtacgggcttaatgggacatagatcaaccaaccagcggttacaatgtcagctgtccccgagctgctgctgggtggtggggaggggggccctcacctgagcaccttgtgcgtgatgtcgtcatctgtgatcccgctgtaagtcaggtcctcattccacacgggattcagtgtgttcctctgagtcttcgtttttagcttattggcctgggatgtggggatgaaaggttctcaatacctgtcctccagccccacaggctggagtcatgggctgggccgggcggggcgagaggaggctgttaccttacaggctccaggcagcaagtgcagcttgacgtaggggtcggcgaggccattgaaatccatgggcttgaggccctggagaggagggcaggggagagggctagaggctcccggcacctctctccatccctcttgtagagctggaccctggaggagcccagaaggagggggcaagggcaggacgaaggagcaggcctgggaagggaaggaggaatgggccccctctgggggctgcacgcaaaccgggcccgggcttgggtggcagggagtgcccaccttggccctgaggatgctacagtgcagagtgcaggaggcccggtcgtagagaaggtcaaactccagcgtgcctagggcggctggagagagaggaaaggcagcatgggtcggtatggagacaggtgtgtgcgagaggccagcaggtgggcactggctctgtgtgtctctctctcttgccagcccgcgagtgtgagtgcaagaggctgagtgggcccatgcgtgtgtgcgtctgggtccctggctcggccgcaactggggctgtgtgggtggtggagtgtctcagcagaaatactgaatattgagccttgctgaagctgtaatctccacgctgactgcagctgtggtggccgtccctgccacccccccactgccctcctcccctacctacatgcacagccagcagggcccatccccctctccccccaccacggcaagcctggagacccccaccagcacatggggcctccaagcccccagactcactggcatcatccgagtcatagctgtccacctccgcaccatcctcaggcgtggtggccccaaggagggctgcagggggggccagagccagggggaccagatgggcgggggcctccccgccgcccccgccgcccccttcaggtcctggtccccgggggaagtagtcagagatctggcggatgggccggatgggcccggggcacacgttgatggccatgtgctcctggatgttgatggtcatgcgatcgcccctgcggcccctcatgcagcacccctggctaggagagggcgtgtgagccagtgagcccatcatacctagccatcctggctgagggccaggcgacggcctcctcggtctgtggggccctcactggcctcccttcctaggtgtcgagggagagggtggtgtgtgccagccggtggcaggtgggaggcctgggccctgcagaccccaagctgactccacaggggctgggctgccaacccactccttgcagaagtcgaggttgcaccaccccgtcctcacccacccacttctaggttgtccctgtatcatcttgccagctccttcctctcctccggggctcccctctgctcctgagcctgcctgtcccccaaggggccctgcagggccccgcctctgtttctcggaggctctgtcctcctctgcaccaggcgctggtctagtcagggtgtcacccacccctctaggctccaactgcccactgtcccctcattcagccccaggacctgtctgcctgcctggttcccccgctcgctcaccacagcccacggtggagaccccagcctcagatgccacctctggctcctcaggggagccagaaattgcagccgcaggagagccgaacacccccgtagcgcacacaggctggcacgcttccccgcaccctcacgcccccggcctgcccagccccctgcacctgcctctgcctccaacaggtgcccaggcactggggggacggcgggcgcaggctgggcggcggcggccggcgaggagagcgcggagtcgagctgtgcgagccgagagggagggagcgccgagaaagtgcggggaggagggggtgagcgaggtggaggcgaggatgcagccggcgcggcggcgggggacggggaggggcgctggggctggggagggggcgggatctcggactcccacccggggcccgctcgggagcgcacgcgagcgcgcacacacacgtgtgctcgcgcgcgcacactcacgcaggggcacgcggaccggcacacactcgtgtgcacacatccaaccgggcacccccgcgcgcacacgcccgtgcccacgtgtgcacgctcacacccttgcacacacccaggcgcgcgctggcacacttacccggagaacttcgcacacacacgcactcgcaaacacgcgggctccctgcgccaccaggaagcagccgccagaatcgccgggtgttccccaactactcctgggagacctggccccccgcccccgcccgcgcgcgcggccacggcgcctccctccctcccgggtccccaaggccggaccaccggcctcgttgtcatggcgacgccggctcatctccccccacccccgcgcgtcttcacgcccctcccccgcagggagctggggcctccctcctcccttccccacgtccgtagggacccacaggttgacaggagcagggggtcgcctgctgtcaccggccggggatctcggggtctcccgagccaggctggggagcctcacgatctgagggaggaggcagaggtctgatgctgcggcttcccccacgccccctccctttggccgttcaggcctctctccttgtggcccaacccaactcccaggggcccatgtccccttaccagggatggtatctcctttgggaaccaccctcccccctgccatccccagttctgccccgcaggtgggaaggggcgtcggggcttggctctgaaggtctcagagccctgcggtagttccccatgggctgccatttctcacccaaaccttgccacccccaagccgcccccctgcccggccctgcgcctgccacggagtgtcagtccacccctggccttcggtcttcactcacctgtgccccaaacttaccatcccgaagacacgaaggggcttatcaccctcgctgcccaccactgactcacccaaccgtttcctgcagttcctgggacacacctagacggctcaggcctagggatcttggctcacatgcgctcctctacctgggaaccgcgcttccttaggaagtcaccgtgggtcccctcttcctaggagccttcctggggcatcccgcactgcccctcagctccagcgccgtcaggactcggctcagcaccgcttcgccagtgcctcccccaccagcagggagttccactggagcggctgattcatctgggagtccctaatgtcccaaactgggcctggcacgaagtcggcatctctaagtgctgttatttaaaacagcaatctggttgcacgacaactgaacatacctaacaccacctaatcttacccttaaaaatggtgaagatggtacatttcgatatgcgtatttcacggcaatttttttttttttaaataagagaaatggggccgagagtggtggcgggtgcctgtaatcctagctactccagggactgcggcgagaggatcgcttgagtgaagccagcctgggcaacacagtgagacacagtctcttaaaaaaaaaaaaaaaaaaaagtaagagaaatgtaaagtcaacaacactgagggggcggggcgcagtggctcacgcctgtaatcccagcgctttgggaggccgaggtgggtggatcacctgaggtcaggagtttgagactagcctggccaacatggtgaaaccccatctctgctaaaaatgccgggcgtggtggtatgtgtcttgggaggctgaggcaggaggatcgcttgaacccgggaggcggaggttgcagtgagctgagatcgtgccactgcactccagcctgggctgtaagagcaaaactcagtctcaaaacaaacaaacaaacaaacaaacaaaaaaccctgagatatcacttattacccataaaatgggcaaagccaaagtgtctgggctggggggaagctgagacggactgatcccttgagctcagaagttcaagaccagcctgggcaacatggtgaggccctgtctctacaaaaaaaaaaaaaaaaaaaaaaaaaaaatccaggcatagtggtgtgtgcctgtggtcccagctactcaagaggctgaggtgggaggatctctcttctttttttttcttttcttttttttttttttgagatggagtctcgctctgtcgcccaggctggagtgcagtggcgtgatctcggctcactgcaagctccacctcccaggttcatgccattctcctgcctcagcctcccgggtagctgggactacaggtgcccgcctccacgcctgactaatttttttgtatttttaatagagatggggtttcaccttcttagccaagatggtctcgatctcctgacctcgtgatggtgggaggatctcttgagcccagaaggtcaaggctgcagtaagctataatcactccactgcactccagcctgggtaacagagtgagaccctgtctcaaaaaaaaaaaaaaaaaaaaaaaatccttagacccagaaattccacttttaggattttatcttacagatatgccaacccataagccaaataatagaagttcaaattctttttttctttttttttttttgagacagactttcactcttgttgcccaggctggagtgcaatggtgcgatcttggctcaccgcaacctctgcctcctgggttcaagcaattctcctgcctcagcctcccaagtagctgggattacaggggcgcacgccccacacttggctaagtttttgtatttttagtagagacggtgtttcaccatcttagccccgctggtcttgaactcctgacctcatgatccgcctgcttcggtctcccaaagtgctgggattacagctgtgagccaccgcgcctggccatgaagttcaaaattcttaaatgtagcacgttccaaaagactggaaacaactgagatacccagaagcaggggaccagttaaatcagtcatgatgtaattccatgcagtgaaatagggtgcagccacaagaggctgttttgctcttgtttagaatcatctttttttttttttttaaatatacaaggtctcactactttgcccaagctggtctcaaattcctggactcaagcaatcctcccgcttcggcctcccaaagtcctgggattacaggcgtgcgccactgtgcctggccctagaatcatttcacagtttcattttaacttagaaaagccaagtgcaggccaggcgccatggctcacgcctgtaatcccagcattttgggaggccaaggcgggtggatcacgaggtcaggagatcgagaccatcttgtctaacacggtgaaaccccatctctactaaaaatacaaaaaattagctgggcgtggaggcgggcaactgtagtcccagctgcttgggaggctgaggcaggagaatggcatgaacccaggaggtagagcttgcagtgagccgagattgcgccactgcactccagcctgggcgacagaacgagactccatctcaaagaaaaaaaaagcaaagtgcaggctgggcatggtggcttacacctgtaatccccgcaatttgggaggccgaggcgggaggatcacgaggtcaggagttcaagatcagcctagccaacatgctgaaacgctgtctctattaaaattacaaaaattagctgggcatgttggcgggcacctgtaatcttgggaggctgaggcaggagaattgcttgaacctgggaggcggaggttgcagtgagccgagatcatgccactgcactccagcctgggcaacagaacaagactccatctcagaagaaaaagaaaaaagaaaaaaaaatcaaaaaagaaaagcaagtgcagagaagcatgcttggaatactgccatttgagagggaaagagcttagccgtgtttgcttagttgttcatatgttgtttctggaggcctgcacaagaatggtaactgtgtctcttgacaagctgagagagtgaaaaaataaaaataataataaaaaaataataaatacacagaagaaaatataactatggtgacctctggggagacagggcaggaagaggaaagacttacttttcaacgtacatccttttgtattttttgaattttgtgccacatgcataggttacctgttccaaagaatacattaaaataataaattttggtatttctttgtttgtttgtttgtttgtttgtttttgagatggagtctcgctctgtcacccaggctagagtgcaattgctcgatcgcggctcaccgcaacctccgcctctcgggttcaagtgattctcccgcgtcacactcctgagtagctgggattacaggcacccgccatcatgctcggctaatttttttgtatttttgtagagatgggttttcaccatgttggccaggctgatcttgaactcctgacctcaggtgatccgcctgcctcggcctcccaaagtgctgagattacaggcatgagccactgtgcctggccaaattttggtcttgtctttttctttcttttcttctttccttccttccttccttcctttcttccttccttctttccttcctttttctttttttttttttttttgagacagggtctcactgtgttgcctaggctggagtgcagtggcaagatcatagctcacgacatcctcgaactcttgggctcaggcgatcctcccactttagcctcccatgtagctgggactataggtatgcaccaccatgcctggctaatctgtttttgtttgtttgtttgttttgtagagatgggtcttactatggtgcccaggctggtttcaaactcctggcctcaagccatcctcctaccttggcctcccaaagtgctgggattacaggtgtgagccaaagaccatgcccagcacaataatatatatatatatatatatatatatatatatatatttttttttttttttttttttttagacagagtctcgctctgttgcccaggctggaatgcagtggcacgatcttggctcactgcaacctccacctcccaggttcaagcctcagcctcccaagtagctgggattacaggtgcacaccaccatgcctggctaattgttgtatttttagtggagatagggtttcaccatgttggccaggctggtctcgaactcctgacctcaagtgatctgcctgccttggcctcccaaagtgctgggattacaggcatgagccactgcacccggccaatatttctaaagtaaaggcaaccgttaggtttccttcgtggctctccagaataagaaaggaagcaggacgaagggagacacagtgcagtgtgaaagccggtgagtttagcaagagggtgtccatgacctgggcgcagggggcctgcagtgaggggagggggacactctggtcaaggaacctgtcgagtcctctctcctgtgctctcttcccacggtgcttgctcaaccccagccctgcctgcctccagaagaacttgttgaagacaggtaaggatgaggctggagttcaagccaatttcagaggaaaatgatggacagtgctgagccctgctttgtccagagacgggaggcttttgcaccagtcacccagtcattcagtaaatattgactgaatatcgactatagattgtggggatacaaccaggcccaaggtcaatgagctgtgacttcacagcctcatagggaagacagacaaatacacagacaatccccatccagggaaactgacgtggggacaggggatggtcagaagccatgggaactcagggtcctatgaggtaggagggaacaaagattaacacctcacttcccagaaaaggagttgtctcaactgagacctgaaagatgaggaggagttacccaggtcaagcttgggggcaagtgtattctaggcagaggtgtgtgccaaagctgggaggcagtccagagtacggcatattcagaaaagaaatcattctaccagcctggtcaacatgacgaaaccctgtctaaaaaaaaaaattagccaggagtggtggtgtgcacttgtagtcccagctactcgggaggctgaggcaggatgatcgcttgagcccaggagtttgaggctgcagtgagccaagatcaagccactgtactccagcctgagtgacagagtgagaccctgtctcaaaaaaaaaaaaaaagagaaaaagaaagaaagaaatcattccaccaaaaagacacctgcacttgtgtgtttattgcagcactgttcacaataggaaagacacagaatcaatctaggtgcccaccaacagtggactggataaagaaaatgtgatatgtatatgccatggaatactatgcagccataaaaaagaatgaaattatatcccttgcagcaacatggatgcagctggaggccattatcctaactgaattaatgcggaaacagaaaatcaaataccacatgttctcgtaagtgggagctaaacattgggtacctatggacataaagatgagaataacagacactggggactccaaaaaaggggagggagggaaagagtcgaaaaactacctattgccgggtgcggtggctcatgcctgtaatcccagcactttgggaggccaaggtgggcggattgcttgaggccaggagtttgagaccagcctggccaacatggcgaaaccccatctctactaaaaatacaaaaataattaagtgggcttggtggcatgcgtctgtaatcccagctactcaggaggctgaggcacaagaatcacttgaacctgggaggtggaggttgcaatgagctgagatcgtgccactgcactccagcctgggcaacagagtgggactctgtctccggaaaaaaaaaaaaaaaagaaagaaaagaaaattgaggctgggcgctgtaatcccagcactttgggaggccaaggcaggaggatcccttgagccccggagttcaagaccagcctgggcaacatagtgaaatcctatttctaccaaaaaaaaaaaaaaaaaaaaaaaaaacttagctgggcatgatgacttgatgatgcagtcccagctacttgggaggctgaggagagaggattgcttgagcctgggaggtcgatgctgcagtgagctatgattgcaccactgcactccagcctgggcaacagagtgagatgctgtctcaaaaaaaaaaaaaaagaaagaaagaaaattgaaccaacagatctttttattcttatcttttacagatgggattctctgtcacccagcttggagtgtagcagcacgatcatggctcacttcaaccttgaactcctggcctccagtgatcctcccacctcggcttcccaaatttctcggattacaggcatgagcccccgaacctggcctaacaggtctcaatttggggttcattaggtgagagataaggaagcaggatgattcctaggtttctgtgttgagcagaccatctagaggaatgatgggaccatccactgagacgaaaagatgggagcagagcaggtctggagtaggactccatttgtgatccattgccttggagatgtatttggacatcacaaacagacatctcggagtctggagctccaaggagaggtctgggctggaaatatacatttgtgagtcactggcatatagatggtatttaaagccacgagtatggatgagatcacctaggcagagaatatagatagcaagacaaggccccatgctgagttggctggagaaggagtcctgagaactggtgagtgtggttccagggctctgagtcagggacaggtgcacctgctgggaggcagacggaatggaaagagagagaaccatttgatttggcagattatgagctcttttgtggacttgatcaaagcagcttcagtggattggtggggactaagccagattagaagaggttgaagaattggctgggcgaggtgactcatgcctgtaatcccagcactttgggaggcagaggcaggcagatcacctgaggtcaggagtttgagaccagcttggccaacgtggtgaaaccccatctctactaaaaattaaaaaattagctgggtgtggtggtgggtgcctgtaatcccagttactcaggaggccgaagtgggagaatcgtttgaacccgggaggcagaggttgcggtgagccgagatcgcgccactgcactccagcctgggtgactgaatgagactccatctcagaaaaagaagagattgaagagtccattaaagatgagggagtggagacagcaggtgtagatgacccagagttgcccgtctactctagaatgatgcgcatctatgagttctctcccttgtcattcttgaggtcagggaccgtgccgtggtgatttctgagtcataaatggagtccagccagtgcgtagcaggagctcagcacgtttatgtcatggatgaataaatgggtgaatggataatgcattgtttgggtcaaaatggcctttactagtagagatagcttaatgtttttgaagcatttgaggaaacaaaagaaagtcaaccccaaaggccataggttctgtgtcccttctcccagctaacctcaaggagcagttgcctgtgggcctggggcacgagccctggcccagcgtcgggaaccaggttatttatttattgagacagagtctcgagtgtcacccaggctggagtgcagtggtgcgatcttggctcactgcaacctccacctaccgggctcaagtgattctcctgcctcagattcctgagtagctgggactataggcacgtaccaccatgcctagttaatctttttttttttctttttctttttgagatgaaatttcaccctgtcacccaggctggagtgcagtggcgcaatttaggctcaccgcaacctctgcctcttgtgttcaagcagttctcctgtctcagcctcccgagtagctggggctacaggcgcatgctaccgcacccggcttatttttgtatttttagtagagacgtggtttcaccatattggtcaggctggtcttgaactcctgacctcaggtgatccacttgcctcggcctcccaaagtgctgggattataggtgtgagccaccgcgcccagcctttttttggatttttagtagagaggagatttcatcatgttgggcaggctggtctcgaactcctggcctcaagtgatccacccatcttggcctcccaaagtgctgggatcataggtgtgagcaccgcgcctggcccaaaaaccacattactgagtcccttctgctgcctctcacatgccttgtggctttggataaatcccttcctttttcttagaagtgatctgcatggcggctcacacctgtcatcccagcattttgggaggccagggtgggagaatcacttatgcccaggagtttgagaccagcctgggcaacatagcaagactccatctctgcaaagaaaaaaagaagtaggctgggcgcagtcgcacacgcctgtaatcccagcactttaggaggccgcggagggcagatcacttgaggtcaggagtttgagaccagactggccaacatgatgaaattccgtctctactttaaaaaactacaaaaattagccaggcatggtggcatatgcttttgatcctggctactcgggaggctgaggcaggagaatcgcttgaaccaaggaggcagaggttgcagtgagccaagatcgtgccactgcactccagcctgggcaacagacagagactccatctaaaaaacaaaacaaaacaaaacaaaaaataggcaggtgtggtggtgcacgcctgtggtcccagctacttgggaggctgaggtgagaggatcgcttgagcccaggaggtcgaggctgcactccagcctgggtgacagatagagcaatatcctgtctcaaaaaaagggaagccatcagcgcagcacaggggaagcagcccacgtgagccagtcccatagatattcgtttccctccttccccacccccgccccgctgccccctttttttctctctctgggctttttacttgtttaggaactcgaagcggttcatggcaagtaccccgagtcctagcccacctgctctctgcatagggttgcggcagagcacctcacacgcgcagatacacgcctggctttaggggaagtcgcggcactgggtctgcagagtccgctgagcacgcaccttcgttgtgaaactaaggaaaccctggagtgtccttgggcttgggtgggatggaacatgcccgtgacagacaggcccacctgccaatcagaagggcgctctccttagctgggatggggccgcaggagtggaaatggctgttgggaggtggcagagatgggagatggggtggccacgggggagccgccggccacagaagaggaaacggaggtgcagggagcggagtctgcgaaggacgcgtggatggccaagagatgtgcctcggaaagggccgagggacttcctctgaccaacccccgacggccattcccagccatccgttttcctgcagccgcggatgcaacctgtggaagaggcgggaggaggcccgggagtccgccccgctgcgcctttcctagggtgggagcgtggactcaggcgcggccgctgctgccacctagtgggagacgcctgctactcctctcggttcctaaccccagggtcgttcccggctgagcactaaggagggggcgggggaggacggagagagccctgtgcccctggatctgcggataggatgcaagggggagcctcagagaggaaccccccccccaggaagtgtgcattgcccacactacttttcccctctgtgccgtgatttcctcccgtgtataagggaggcaagagtacctgcctctgggctgggcttggtggctcacgcctgtaatcccaacactttgggaggccgaggcaggcggatcatccgagttcaggagttcaagaccagcctggccaacatggtgaaaccccatctctactaaaagtacaaaaatcagccgaacagtgatggtgcgcgcctgtaatcccactccaggaggctgaggcaggagaatcgcttgaacccaggaggtggaggttgcagtgagctgagattgtgcgtctgcactccagcctggcggacagagtgaaactccatctcaaaaaaaaaaaaaaaaaaaaaaaaaaaaaagagtacctgcctctgagggtcagtgcaagagcaaatgaacaaatttgtgcaaggtacttggccataaatggggtccagccagcatagtaataggtgttcaataaatgctacctgctgggcatggtggctcatgcctgtaatcccagcactttgggaggccgaagctggaggatcacctgaggccagaagttcgaaaccagcctgggcaacatagcaagccctcatttctacaaaaaatgcaaaaattagccgggcatggtggcacatgcctgtggtcccagctactcaggaggctgatgtgggaggatcacttgaggccaggagttcaaggctgcagtaatcataccactgtactccagcctgggtgacagagtgagaccctgtctctgaaaatacataaaataggccgggcgctttgggaggccgaggcgaacagatcacctgaggtgaggagttcaagaccagcctgaccaacatagtgaaaccctgtctctactaaaaatacaaaaattagccgggtgtggtggcagacagataaaaggaagggatttatccaaagctgtaatcccagatactcaggaggctgaggcaagagaatcacttgaacccaggaggcagaggctgtagagagccaagatggcgccactgcattcccacctgggtgacagacagagaccctgtctccaaaaaaatgaaaataaataaaacaaatgttacctgtggttgatccaaggggtaaccggaggtgtgtggccctgtgccaccaccccaaattgtgcctgttgtccaaacacagcttcctttagttcgggctttcagcaagatggccgtgccgcatccctcctctttgtaaatgctggggctgccaccattatggttttatcatcagcgacattccagggggtgaagactggtcccaacctctcttctcctctcctcttctgatgagagtgagggatgggggaggggtcccagctcctagcactttctcccctcaccccaaagtgccatcagaacagctctgggctgtgacatcacagagcccccacctcatgataggagtcatgaggctgtggccatgggtgctggtgtgggtgtggctggctgcactaggggccatagaaactggtaagaagctgtcttgggagcagcaggaaggcaggcagctctgggagcataaagtgtgatgcccacttagggactcggaagccaaccctgcaccctctcattttctctccactcttctctcccatcctgctggtcccacctaccccccaacaaccgcgagccttgtcgtggtgcacccagctgaccctgagggaaatcaagaccctccacagcctctgcaataaggctgggtggtctcacagggtcccaagtcagcttccgcctcgagagataaaggcaggggtcagcttggctgttgtcacagagtttgcttgggtcctagcacccagacccaagcgtgccacggcgtcagccctggggacagagtctccgcgcttcttagacagacctgacttcttcgattatccggactcagaccaagccaggctgctggctgtggcccagtttattggagagaaacccatcgtgttcattaactcaggtatgaaccagcttgagaagggacctccctccccgccagggtctggaggagagcagccccagacccttcattgggccatcagaggggagttaagggtcctgtttgtctagcaggttccagccccgggctcttccatcacatcctggtgggcttgctggtggtggcgttcttctttctccttttccagttctgcacccacatgtaaggcctgccccctttctccaaccccacccaccaccaccttccttgggagcggctgaagaccccagttctagcggggcaggctgtgacctctcccctctgatctccatgccccacagaaacttccagaaaggggcctaaagagccggacaagggctctggactcaacctgagcacccacacccacctcctctcctgttgatgagcaaaagttccctgctttcctcctccctgactgcccagcgagcagctggggatcctgtcccctctgtttcccatggcccaagccccccacctcctcccttcccagccccaaagaacttggtggcaagggccttggtggcgttcacgcagatcgtcttttattagcggtctgtaaagcacctcccagggtcccccgaccccagattggaggaagccttgagaggtcagtagcaccagggacatggcagggcccgagggcgcgatgtgcagccgatggtgagggactgggcgccctcgcctgcccccggggttgtcagcactgggaaggcttgggggtagcagccacctccttcccccaacccaacagactagttcaaatttgggtaaataaataaaataaataagattcctcaagctggcctaccctggagaggagccgtggttgcagccggccactcgggaggcccgagggccagcgggggttagttggggcgtcctctcctctcgggtgatggggagccctgggggatggcagcataggggctgggatggccttggcagaggcgtctccccacattctgactcctggtccccttgaaaccctgttggtgtccctccccacaagccctcctgccctcagtgggtgggaggcggtgccccctcccctcctccagcgcaagggtgtgcaggaagggggcagagtagggggaagaggtcccctctctccaccccctcagtccccgagagatggggcctcttccctttcggggtcatcgtcagtcctggggttgtccgggcaagaggaccctggctcccaaccccagccatcagccccagagccctgtctccacgggggtgggggtggggagggggagggtcccggcccccggcctcagtcctgggcctggcaggccgggggcggccgggagcggggccagaagaggcggcaggccccacggcagatgaggaagaaccagtagagctgaggggccaggagcagcgcagcgcccaggttgacgtgggcagggatggccaggggcacggccagcaggggcaggccggcatggcgcccgtaggcccagtacaggtagggaaagagcagcacccggcagcagaggaagctgagcagcatcagggccccgttcaccttgtgcagcagtgtgtgctgctgcttgtactgaggagacacagacacagtggccacggcagcagaagggctcggccccccttggccctctccctgcctccctgcgaccctagcaggcagctcctcccaaaccagacactttgccaggacacaagcaccaggtgctcaaaatgcacggggtgagggggggatgacgaaggggctagagcccttggcagcaaccttgaaggtccctccccttcctgtgacctccccattgggctcctgcaccctcccatgctcactcacctggatgaggatcttgccaaggcagacgaagggcgtgctgacctctgccatcaacatgcaacccagaaagaagtctcccttaccctgtcgccacacctgggcacagaggcaggaaggtgaggagctggggctctccctgggttcttgggcagcccccgcccttcctctttcccctctgtcactttgggagatgcttgactctgaacatcagaacacctgggtgcagggctgggtgcagtggctcacgccggtaatcccagcactttgggaggctgaggcaggtggatcacgaggtcaggagtttgagaccagcctggccaacatggtgaaaccccgtctgtactaaaaataccaaaaaaattagccaggcgtgttggtgggcacctgtaatcccagctactggggaggctgagatgggagaatcacttgaactcaggaggcggaggtttcagtgagccgagatcacaccactgcactccagcctgagtgacagagagagactccgtcttggaaagaaaaaaaagagaaagaacacctgggtgcaggagcaggtgcatgacttggctgcatccctctcacggtcctgcagaaagactgtgtcccttatgtaacaggtgaggaaactgaggctcagagacgtgcaaccacaaatccaaagagccacagccgggcatcgtccagcccagggccaggctgcccccacaccctggtgccctgggctggtgctcagtgaaccctgcctgtccacagctttccctgggaatacgctgggtctgcttggttgtcagtacgcagacccggggcttcccaggctcctgccagcaccagcaggaccaaggagcaggccacccgcaccccgcccgcccagctccccgggactcaccactgagagtgggaagcacaccagcaccatggcggcatggtggagcaccatgaggaactccttgtgcaggtagccacgcgctatggcccacgtgctgcccggggctctggccgctccgtcgtcccctccatgccctttgacctggtgcttgtgccagtgacagaggaacatggcgtagatgtcgtagatgaagtagggcacagcaaattgcgtgtaggcagaggacagccagtgtctgttgggcagagagacggggtgggggagcaaggaggaaaggggacaccagtgattggggtcagatctcaggggtcagcacagcagccctggacaggagcggagtcttgggtacagatgagggatccagagggtagagggtgagaaacttgcccaaggtcacacagtcatgcagctagtaagagatggtgctgggattcaaacctgtggtctcagaactcacccatgttcctctctctctgcagtatagtcgggggaaaagaaaagaccagaagatgcccacagaccaaaaggcacagatacagtgccaaaataagcccaggacaggcaggtgggaccttgccatggttatttgtcctaaccttaccatgaggttaggaccagcaacagctgaaggggcgagagtgctggagagagaggtcacaggggtggacgcccattcctgcctcctgggacaggcgatcttccaaacttcccatgcatagccttatttacccctcccaaaaccctgtaaaaggtaggtgtggccatcatccccactgtacaggtgaagaagtgagtcacagaggggctaggtaacctggccaaggaagggacatgggcggtgtggctccacagccctcactgtcatccccaccatccccagaagatccgagaggcatcagagacagaccctgttggcaagtgagaggtcttgtcagcgctgttcgccctgccccaaagtcacccaatctcttgtctattttgtgttgtttttcagggacagccaagcgttaaggggaaaatgcagagcaaaaggagccaaggacaaagaaagttccatgtacttggagagtaaacaaaaacgagaaatggatgaatagacaagacagcatttttcttctggagtcagcacattggcagtttctcttaaatcctgtagtcccaagactggcctggggtgggggcaggaggtcagagaggcaggacctggggtgctcgccccacaaggggtggagggatgaaagcagagtcagccagaagccatcaccaaacatgaggcacgtggaggaggctgtggagaagttggggctgaggcctctgaggatggggagcctgaggcaggcggcctgtgagtggagccaacccattctccagcagggacggtaccagggaaaagggaacctgagactggtgcagtggtgtggagctgcggcccagaggcagggaaagatgagaggggaggggcagctgtagagaacgcgaagcgggaacacagggagagaggtcccaagtggcctggaggagtcagggcaggaagctgcccagaatgcaggcccagcagaggtgatgggagatgggacagctgggctggtgcaggagaccaggaggggccaccaggccctgggctgtcatgtgaggtgttagatcccatccccaccctcttggcaattaggtgctcagaagtaggaacagctgctgccctggattaacccggatcctccccacctacctgaggattaaagcagggaagacggacaggaacagacacaggggggcctggggagcagggggtacagaagctaaacggtgacctctgcatgtgaaggctggggaggaagtgctggatcccaggctcagcttggagcaggggagggaaggggtgggcagaggccaagaagcagccaagtccctgggcggggtctgaagaaagagttaagccaagaactgtcctctgcagctgccacttaactcaattcctctcgctgaagcccttccaggaagggccgctgcctcaccacagaagaggcaactcatcttcgggaaaagaggaggcaaacagaaacagggcaccccccatcaggggcgtccaaatgttccctgggactcagtggctgccacagaagggaagcggtgctgaaagctacaaagggggcgttgtgggcacctctaaggcaacttgcaacgggccacccgtgggtcacctagggcggccgtcagcaccacggacagggcccctctcctccccgtccccccgcctcctgcctgcacacctctgggcctttttggcaaccaccagacactgcagcagctgcctggccacattttggcctcttcaccctcatcccctcccgcactgcctggccgtgtgtggccttgtgcgtgtcatctctcccttgtcctctccctcaggcatggagtggatgccggatgcctggattatgggaagggctgaggggtgagcctggcatgaggagggggcaccccatctgggtgctggctggaaatggggtctgcctcctggggtggaaggcagggaggaggtggggaaccacgacaacacgggagacctggaagccgactagaaagcgctttgaggatcctctctgatccccgctccttctccccctggttctgacctttaaggacaggacaggataaatttatccctgggtgttgagttgcggttattgcagttaacttgctcaggcccaagttaagggcttggggaccacagacagagttccctccaagatgtggggtcttccgggattacccgtacacgccaaccactggcacctgggcaggggggtgtctcgcagcacttactggtcatcaatgatgtgcttgcaggaggtggagacgatgtagccggcagtggaggccatgatggcctggacagaggacaccagcctgggggagagagggaggcgtgctagaaaggcagaagggaagaggcgtgtgccttgatttctcctcgttgctagtctaacgactgcgctttgcgttcagccacttctcgggccagtccttgcctgccttcgcccaaggctgggctgcctgaggtgtgccccaccacaggtacctcacggctctccggcccgctcggctgctgttcctcagtccaccccactccttgccaccttcttccttccccatttgtggaaactgagtctccctcttctcaagcccgcagggtgtctgtcctgaggtgagactgagagtgaactgctggcctggacctctccccacgaggggagcctgggccggttcttgccccgcttagctgtccagtcatgacgcaggcctcactctggaccctttgtgaccccgagttccccagtcactttcccactgtctcctgactgccaccagcctccactctgcactctggccctgttctaggggtgtagagttgtaccatccactcctccatccctggcccccaaacactcaccctgaatgacacctagctgtctggccctggcctcagtccctaatgtcttataggaatgtcttcgccgcatgctggccctgttttggagggtgggagggtgtacggggaagaagagagaggcgggctgaacactagtagaccagatggccgggctggatgaggtctcccagaacagtgagcaaggcaggcagtgaggagagaggaagcctgggggtaaagccccggacccccacaggagctcccagtcccccaccgctgagggtccagagaagtgccaggtcccttccattccctgagaagcccaagaagcagacaggggctgaggggaaagaaagtggtttacctggctgagacaatgactgcgtcggcctcctcccagcgtagctggggcagccgctggagcgtgttcttggagaggaggaagagtccggggaacaccacccccccggccaccatcggggtcagcatggtggctcaggacttgggcagggaggcaggcgggccgtgaaggggcagggaggccgagtggaaggagttaggggtggagaagggacgccaagcccgggaaggagggagaaaacgatgagaaggggcacaaaggggccagggcggggacgggatggggccagggagtccgatgaaactggggagtcgggagggggctggctgggcagagacgggggaggggaggatgggagaaggggagcaggagcaggccagcgagggatggggagaggcaaagaggggatggcttggtgagggacagagaggaagaggggacaggaggaggaggatgcggatgggggaggggagggagccaccaggcaggtggggaggggaggcttacgtgagaggctgggagggcccgaggaggcggggagggggtgggggtgggtctgagtaccagccccaaaggaaggaggtgggcgggagggagcggaggagcagccgggcaagcggtcagcggtcaccaccgctctcctggctccactgcctcctctcgctgccgccccagtccctgccgcccggcacagacaccgcacatggcatcatcatagagactccgtgcccagccccctgccccctcggtggggagggggagggggaggggaagtggccagcttggggaggacgggggaggggcaggaaaatgatggcaccgaccagacaccgagaaaccggacctgcagcggcgtctccccatgcagctctgagccacagccgcggctgcgacagagatggggggagcagagaaagagggagggggaggcccttaaaggaacagcagctgcggtggcacagggggctgctggggacaggggacaggggccagctcttctcttggggaggaagggggcccagggctccttggccagctgggagggggccctgagcccccacaggggcctgaccctgcttcccatcagcactttgcaaatgcctggcatctcctccctcaccaagccatccctctgtggcctgccccgggtccgagctttgggtggccattccagcggaagagagcgttccctgggagagggagtaagtggtgctttctcagaaggaagagctgaaggaggggataggagcaaaaacatctcaacacagcatcctcagagccagaggccccctcacccgatggcggggaaggaagctgacattggccagagggggcacctgactgtgctgcagggctgcccatgtcctgtctgctgcaggagctccgaggtcactgcgtctgtccttcccacagggccatcaacgatcctgaggctccctgaggtcacccagttcagaagtggcacagccctctcattgcaggcgttggaggggcaaggagtggaagaaggggaaacggtggcgagagcgcggggcagctgcctctcaggaagtcccagggagccctaggatgcccaggccctgttcttcagactgccagcccctcctggccttctctaaattcccacccctcactttttcctcagtttccttaatgctactagctcccctttctctgcaacttccacatacagcctagtttcagagtgggaaaggactgcggggtgggctggtgcaagctcctcactggcccataaggaaagtgaggcctggggactgggcccgggtggagctgtgggacctgagccagagacactgccccctttgacttctggcctcccatcctgctcccaactgtcctgtggacttcagcatgacaagggcctgttatgcaaactcctttggtctccaagttcaatagtcaaccctatggtttgcctttctctgccagagcccactcctcgcctcccccaaagaaaggccagggactgggatttgctgttttgtgctgccctctagcggcaatctgtaggaaagcacccaagaagtctcacgctgatttagagacggttgtagagacaatagcggacctagctcctgtcctcagcccttcacgggagggggaaaggggatccagctccctgagtttttactacatgctgggcacagtaccaggtgatttctactggttcttacttggtatccctgttttacagaagaaacaggtttagaaattttgtggggttttttttttttttttttttttgagatagggtctcattctgtcccccaggctggagtacagtggcgcgatcatggctcactgcaacctcaacctccccgggctgaaatgatccttatacctcagtatccccagtagctgggactacaggcgcacaccaccatgctcagctaatttttgtattttttgtagagatgaagtttcaccacgttagccaggctggtctcaaactcctgggctcaagcgatccacccacctctgcctcccaacatgctgatattacaggtgggagccaccacgcccggatgaaagctgggtttcaaacccatggttgcagccgggcaaggtgtctcacacctgtaatcccagcgctttgggaggccaaggctggcgaatcatgagatcgagaccatcctggctaacacagcgaaaccccgtctcttctaaaaatacaaaaaattagccgggcatggtggcatgcgcctgtagtcccagctacttgagaggctgaggcaggagaattgcttgaacctgggaggcggaggttgcagtgagccgagatcgtgccatcgcactccagcctgggcgacagagcgagactccatcttaaaagaaaacagaaaaaccaaaaaaccatagttgcataaccccaaagccactcatgagcaaaactgcaaaaaggacagaggctggggaggctgggtgatgggcggccaccgtaactactcgattgaggactacaaggctggtcatggaactgtggtttcactttggatgagtagagacaggctttttttgtctgccagggaatccacgtagacaccctagtaaaatctgtgttccgtgtacctcctacgcctcctgtggtttgctgatactgcacttttatggtaagctttgtcacacaggtcatagatctgcagcccaagggcccaatccggcccacagacatgttttgtttggccagtatgcagttgtcagtatagtagttcttaaataaattcttagttacttatcagtattcaagaattggaagaggttgggcgtggtggctcatgcctgtaatcctagcactttaggaggccaaagtgggcagatcacctgagatcaggagtttgagaccagcctggccaacatggtgaaaccccgtccccgtctctactaaaaatacaaaaattagccggacgtggtggtgcacacctgtaataccagctactcgggaggttgaggcagaaatgttgcttgaacttgggaggtgaaggttgcagtgagccaagattgagccactgaactccagcctgggcaacagagtgagattctatctcaaaaaaataaaaagaattgggagacagcccaccacaatgacatgcacctgtagtctcagctactcaggaagccaaggcaggaggatcacttgagcccaggagttcaagaccagcctgggcaacatggagaaaccccgcctctactgaaagtacaaaaattagccaggcatggtggtgcacacctgtagtccaagaaactcaggagtcagcccgattctcagggagaatcacttgtcagggaggtcaaggctgcagtgaatcatggtggtgtcactgcacttcagcctgggtgacacagtgagactctgtctcaaaaaaaaagaagaggccgggtacagtggctcatgcctgtaatcccagcacttcggaggctgagaaggaacaatcctgtgagcccaggagttcaagactagcttgggcaacatagtgagaccctgtctctaccaaaaaaaaaaaaaaaaaaaattagccaggcttggtggtgcattgcctgtagtcccagctatggcaggaggattgcttgagcccaggagttcaaggctgcagtgagccatgatcgtgccactgcactccagcctaggcaacagagcaagaccctgtctcaacctgtctcaacaacgacaaagaatcataactccgaaaatattggcccacgttctaaccatataacattatcagtggctggagctgagcagcactggccctcagcagagaaggtgagtcctccagcctatatcatccctgcagagcccacagccctcatattatctgcagcagttttcaacccctgctctacagacgctgattcatatgatcctcacacaacatctccacgaagaaaggaaagtggggtgttattattaagcccatttaccagtgagggatctgaagttcagagaagttaaatgactcacaaaagaccccactgttggtgtctttttttctttttcttttttttttttttgagacagagtctcactctgtcacctaggctggagtgcagtggcgccatctcagctcaccacaacctccacctcccgagttcatgtgattcccctgtctcagcctccagagtagctgggattacaggcacctgccaccatacctggctaatttttgtatttttagttcagacagggtttcaccatgttggccaggctggtcttgaactactgacctcaggtgatccacctgcctcagcttcccaaagtgctggaattataggcgtgagccaccacgcccagcctgctggtgtcttttgactccacattccagctccactccacactctgcttctgctttcaccacaaactcattctgaaagtaaaagatcagttccaccagccatggccccaggaaggacaccctcaccctggtcctcttacttggatgctaccaggacagcctcttgtctctccatctgcaggttggtgtggttctgcaagccccagcgcagggcagtgaagcacaacgggaagaagacgcaacccactgcgaacagcagggtcatgcctgcctgcagccaagaaggcagaaaaagacggccatgagaacacctcaacacaacaccctcagaccccccagcagccttcttcacccccaatgaggcaagccccaagagacccatccatctgtggccattgaaagccaccaggcaaacctcttctctaagctcctagcatccttattactcttttaatattcctcatccggggcaattcgacatcctaattatcccaattttttgttttaaacactcaatttagacaatttcttttcttttcttttcttttcttttttctttttttttttttgagatgcagtcttactcttgttgcccaggctggagtgtggtggcgtgatcttggctcactgcaacctccacctcccgggttcaagcaattctcctgcttcagcctcctgagtagctgggattacaggcgcccgccaccatgcccagctaatatttgtattttcagtagagacaggactttactgtgttggccaggatggtctcgaattcctgacctcaagtgatctgcccgcttcggcctcccaaagtgctgggattacaggcatgagccactgcacccagctcctcctactcttaaactccaccattttccatcttctgcatgccccgcccgccgcccaccctaagtcacctctaccttctccccagtcctcacctcagagggacaggttggaagacagaaagggaggttgatgtttctcctcagcacccagaacttggaaaaaggaagggagggggttgtcaagatatttggaactttaaaatgacatttgttgaaaaaacaaaataaagccaaagcgattgttgttccattaaaaaagaaaacaaaagaaataacaggtgcaagcctgaaactacatatatttacatagatatcatttttgtttagaaagacctcccctcccatctactctggggagcagaggtgtggagcaggcacaggcaggatgaagggaaccaggtcctgccatcctgccttcctgaagtgtcttccaagggaccttctcgggataaaaggaaggtgtcaaactgcaaaggcacgaggctgctctgtagaggcagttggggagggcaggagtatgctcttccattggtggagtggctagaaggtgccatcctcctaatggcccgccagttgatacatgtgccctatcatttgcttcctgtgggggctggggggcggttccagcaagccttgcctagaattggccaattagaatccattggtgacttgatggacagctatgtttcagggacagggctcaaagaaagaaaaggagaggggaaataagagcaggtgcagggccgggcgtggtgactcacgcctgtaatcccagcactttgggaggctgaggcgagtgggtcacctgcggtcaggagttcgagaccatactggctaacatggggaaaccctgtctctactaaaaatacaaaaattagccaggcgtgatggtgggaacctgtaatcccagctattcaggaggctgaggcaggagaatcgcttgaacccgggaggcagaggttgcaatgagccgagatctcgccactgcactccagcctgggcgacagagactctgtctcaaaaaataaataaataaataaataaataataaaataaaaaaaaaacagcaagtgcagtggttcaggctggaatccccgcacctcagagaccgaggtgggaggatcacttgaggccaggagttcaagaccagtttgggcaacatagtggaacccctgtctctacaaaaaattagaataataggccgggcacggtggctcccgcctgtaatcccagcactttgggaggccgaggcgggcagatcacggggtcaggagatcgagaccatcctggctaacacggtgaaaccctgtctctattaaaaatacaaaaaatttagccaggcgcgttggcgggcgcctgtagtcccagctactccggaggctgaggcaggagaatggcgtgaacctgggaggcggagcttgcagtgagccgagatggcaccactgcactccagcctgggcgacagagcgagactgtgtttcaaaaaaaaaaaaaaaaagaagaagaagaagaataaaatagtccagtgcaatgacatatacctgtggtcccaggtacttggaaggatgaggcgaaagaatggaaagaattgcttgatcccaggagttcaaggctgtagtgagctatgatcataccactgcactccatcctgggcaacagagtaagaccctgcccccccaaaaaagtagtcctaagtaattattgatttaaaaggcggtgtaggataaaaggtaaagaaggccatttctactgtgggtgtacatggacttcaaattcagagtccacagataatcaaagaaacatttcacttccctattgctgaaataaagaaacaaataaagaaacacactgtatggctctgtttacatcaaattcagaaaagcaaaacatctatcatgaaaaatctgaacagcgtttaacttggggaaggtattgactgggaggagaccccagggaaccttctgaagtgttggaaatggccttatattgatcaccagtgtatacatatgtaaacattctcgaggcatcctcttaaaatgtgtgccccttaagtgaagctgcagtttttaaaattctaaatttaggctcttcctttctctgaatgatggtgggcaaagcctttatgggcctcaatttcttcatctgtgaggttgggttaataattagtgtcacatcattaaatgctgcttagactacaggtcagacattgatctgcattctctgactctaaaagaaaaaaaaaaggccaagtgtggtggtgcacacctgtagtaccagcactttgggaggccaaggcaagaggatcacttgaggacaggaggttgaggctgcagtgagctttgatcacgagactgcactccagccttgggccacagagtgcgactccgtctctaaaaaaatcaattaagggctgggcgcagtggctcacgcctgtaatcccagcactttgggaggccaaggcgggcagatcacaaggtcaggagttcaagaccagcctgaccaacatggtgaaaccccatctctactaaaaatacaaaaattagctgggcatggtggcatgtgcctgtaatcccagctacttgggaggctgaggcaggagaatcgcttgaacctgggaggcggaggttgcagtgagctgagaagccgagatcacgccactgcacttcagcctgggcgacagagcgagactctgtctcaaaaaaaaaaaaatttaattaaaaatatcaagtcatttatccaaagcaaccttgtgggtagggattattactgcacctctgttttacagatcagaaaacagaggcacagagaggtttggtaacttgtccaaggttaaacagtcaggaagtgaataaaaattttttaaaatcatattttctgaatttatttgtccctataatgttaggcagatatagaaaacataaacttattttcctaaggaactgaaaggcttttttaaaaaggagggaaaaaacaccactgaatacaatttagacatcctcattcatattttcagaacttatccttctcctcctccttcctctcttttttttttttttttttttttttttttttagatggaggttcgctcttgttatccaggtatccaggctggagcgcaatagcgcaatctcagcttaccgcaaacgtcgcctcccagattcaagcgattctcctgccttagcctcccgagtagctgggattacagccatgcgccaccacgcctggctaattttgtatttttagtagatatggggtttctccctgttggtcaggctggtctcgaactcctgatctcaggtggtctgctcacctcagcctcccaaagtgctgggattacaggtgtgagccactgcgcccggcttcttcctcatattcttttgagacagggtctcactctgttgtccagactggaatgcaatggcatgatcctacctcattgcagactcaaacttctggactcaagcaatcctccttagcctctgcctcagcctccagagtagctgggactacaggtgtgcacacaacactcagctaatttttgtatttaaaaaaaaatttttagctatgttctatggaaaggaatctttgtactttttatagagatggggtcttgctatgttgctcaggctggtcttgaactcctggcctcaagcaatccccttgccttggcctcctaaagtgctgggattacaggcatgagccaccatgctcggccagtgtttgcttctttagctactttattttcttccctctggatgggactctgaaaattaaaagttaaaccaagagcggccaggcatggtggctcacgcctgtgatcccagcactttgggaggcagaagggggtggatcacctgaggtcaggagttcgagaccagcctggccaacatggcgaaaccccatccctactgaaaatacaaaaattagccaggtatggtggtgcacatccgtaatctcaatcactcaggaggctgaggcaggagaattgcttgaacccaggaggcggaggttgcagtgatccgagatggtgccactgcactccaatctgggcaacacagcaagactttgtctcaaaaaaaaaaaaaaatatatatatatatatatatatatgaaaagatcctgagctggggtctgaaaccaggcagcctgccctgctatttgcccagctcctgcatagctcattgtgaggactaaatcatgccaatgcatagaaactacaatacttcacacggtagccagtagccagttactgtcattctgagcacccactgtatgccaggcaccaggctgaaatactttatatacatgttcccgtttaatcatctatgccaccttacaaataacttcctcattttactgctgagaaatctgagtctcagaaaagttgaatgacatgcttcagaccatacagtacatgacaaaatcggtaaatgtgaccgctgccttccaagtctggagaaaaggaggcgaagagaggggaaggcatgaggggaggagagaaggtgggagagggaaaaaggggaagagaagggatgagagtaggagaggcagaaggagtgaggaggagtagcacccctctgcagttattttctttttctttttttttaaatttgagacagagtctcactctgtcacccaggctggagtgcagtgacacaatcacagctcactgcagcctccacctcccgggctcaagtgatccttccacctcagcctcctgagtagctgggatgacaggcgtgcaccaccacacctggctaatctggggaggtttttttttctagagatgggatcttgctatgttgcccaggctggtcttcaactcctgggctcaagcgatcctcctgcttcagcctcccagaattctgggattacaggcgtgagccactgagtgtgaccagggatggtcattttcctctgcacctgtgcttaccctagacaagaaaatgtggaagggaggaaagtttacaggccatgagctggttagagtcaggcccgagtctcactggaatctggactctctcctacatttcttcctttccttgtcgatttcttcttgttgagagcaaaacagtccaaggctgcacaggcttgtctgagagagaaaatatgagaggagaaaattgtggttttgagcaatggctttaaatttttttaatagtgacccacaagagatatcttttattttatttctttatgtatttattttttgtttgtttgttttgtttttttgagacagagtcccactctgttgtccaggctggagtgcagtggcacaatctcagctcactacaacctccacctcctgcgtaaatgattctcctacctcagcctcccaagtagctgggattacaggtgcatgctaccacgcctggctaatttttgtattcttagtagagacaccatattggccaggctggtctgaactcctgacctcaagtgagctgcccgccttggcctaccaaagtgttgggattacacacgcctgtaatttttgtaaaatacaaaaaattagctgggcatggtggtgggtgcctgtagtcccagctacttgggaggctgaggcaggagaatggcatgaacctgggagacagagcttgcagtgagccgagatcacgccactgcactccagcttgggccacagagtgggactctgtctcaaaaaaaaaaaaaaaaaagtgttgggattacagaggtgagccatggcgcccagccgagatatcttttattttgtgactgcagttcatgcacccacacgttgaatggaaaacctttgcacaacacattctgacttactatatgcagtgccctgtggaattttctagaccatttttccaccaaatattgatcatgacccattaagccaatttcactgcccactagtggctaaacaagccaagcgggaaaaatcttggtttggagagcagtgtttctcaatttttctttcattattgttcccctaaggagccctttttacacttttttttctaatcgctgcctatcacgaaagtttaataacacagatatatttatgtctatttacatatatcttttccatattaaaaagagtaagttttttgcccccttgggggcgatattataccagttgagaaggcatcattgtcctaatgctcattttctgagccgcctttatttatttatttacttatttattttattttattttatttttttcagatggagttttactcttttgcacaggctggagtgcagtggcacgatcttgtctcactgcaatctgcccccgctgggttcaagcgattctcctgcctcagtctcccaaggcgcccaccaccacacccagctaatttttgtatttttagtagagacggggtttcaccatgttggccaggctggtctcaaactcctgacctcaagtgatccacccgctttggcctcccaaagtgttgggattacaggcatgagccaccgtgccctgcctctgatccgcctttatacacatcaatcccaacatccaatgagataggattagttccattttgcaagtgattaagtggaagctgagaggttatattaattattgaagattgaaatggctggcaattagactgggaatccagaaacttaccaatatcctaactcagcctctagcttctccaaacctttgtttccccacaaaaaaaaacctcagttatggtcagttatgggtgttttttgttgttgttattgttgttgttgtttttctctatttgacctaataagagcaaacattaggccaggcacagtggctcacacctgtaatcgcaatgctttgggaggccgaggtgggtggatcatgaggtcaggagtttgagaccagcctgaccaacatggtgaaagcccatttctactaaaaatacaaaaaaaattagccaggcgtggtggcacacgcctgtaatcccagctactcaggaagctgaggcaggagaattgcttgaaactgaaaggcagaggctgcagtgagccgagatcagaccactgcactccagcctggtgacagagtaaaactccgtctccaaaagaaaaaaaaagcaaacatttatagagcatttactagacatccggcagcaatctaagccctttatatatattaactaacataatatccacaataatcttaagacagacatactggggtttttgttttgttttgatttttgagacggggtctctcattttgtctcccttgatgaagtacactggtacgattagctcactgtaacctcaaattcctgtgctcaggggatcctcctgcctcagcctcccaagtggctgggactacaggctctcaggctcatcactaccagcttattttttaagtttttcctacagatgggggtctcgatttgttgcccaggttggtctcaaactcctggcctcaagcattctcctaccttggcctcccgaagtgctgggattataggcacaaatcacgtgtcaggtgagacatactctcagtcactgttcggatgaggaaattgaggcacagagaggttgtgtggcttgctcaaggtcatgcaggtagaaagtggcacaagcggggatttgaaccaagtaatctgattttcagagcacaggttgtgcgttttgttttgtttttcaccatgtattattttttgagatggggttctcactctgttgcccaggctggaatgcagtggtgccatctcagcttcctgcaacctccatttgccaggctcaagtgatcctcctgcctcagcctcctgagtagctgggaccataggcaagccaccaccatgcacggctaattttttgtatttttggtagagacagggtttcgccatgttgctcatgctggtctcaaactcctgagctccagcaatacgcccgatcctcctgcctcggcctcacaaagtgctgggattataggtgtgaaccaccatggttagcatgagctaaccatgtccttttttttttttttttaactctgtctcccaagctaaagtgcagtggtgcgatctcagctcactgcaacctccgcctcccaggttcaagcgattctcctgcctcagcctctggagtagctgggattacaagtgtgtgccatcacacttggctaatttttgtatttttagtagagatggggtttcaccatgttgcccaggctggtctcaaactcccgacttcaagtgatctgcctgcctcacacctcccagagtgctgggattacaggcatgagccacagtgctaaactaaccatgtactttattttctttcatttgagatgaagtttcgctcttgttgcccaggctggagggcaatggtgcgatctcggctcactgcaacctccgcctcctgggtttaagctattctcctgcctcagcctcccgagtagctgggattacaggtgcctgccaccacactcggctaattgtttgtattttttttagtagagacagggtttcaacctgttgcccaggctggtctcaaactcctgacctcaggcgatctgcctgccttggcctcccaatgtgctgggattacagaagtaagccactgtggctaccatgtactttaaaaggaaactttttatcactctggaaaatagaaaaccagtaccacctgtgataaacagaaggtaacaaaaaatatacaaaatgaaaacacattttataacattctagctagatactatgggcagctgctcattctgaactggaggctggctctctccttgttcaaaaaagaaagatcaggccgggcgcagtggctcaagcctgtaatcccagcactttggaggccggcgggcggcgggggggtgcggattaactaaggtcaagggttcgagaccagcccctggccaatatggtgtaaccccatctctactaaaaatataaaaattagccgggcgtggtggcatgcacctgtaatcccagctagtcaggaggttgaggcagaagaattgcttgaacccaggaggtggagatttcagtgagccaagatcgtgtcactgtactccagcctgggcgacaaagcaagactccatctcaaaaaaaaaaaaaaaaaaaaaaaaaaagaacaaaaagataagcacagagagaaaggtgttaaagggtttctggcagcaaattgagagtttctcctgcagtaatcagaagcgttgaaagggaattggaaagagaaagagagtagcttgttcagggtgtgtgtgtggtgtgtgtgtgatgtgtgtggtgtgtgtgtggtggggtgtgtgtggggtgggtgtatggggtgtgtgtgtggtgtttgtgtgtgtttgtgtgtgtggtgtgtgtgtgtgtggtttgtgtgtgtggtgtgcgtgggtatggtgtgtgtggtgtgtggtgtgtttgtgtagtgtgtgtggtgtgtgtgtggtgcatgtgtggtgtgtgtgtatttgtgtgtgtggtatgtgtgtttgtgtggtgtgtatggtgtgtgtgtgtggtgtgtgtggtatgtgtggtgtgtgtgtgtggtgtatgtggtgtgtgtgtggtgtatgtggtatgtgtgtggtgagtggtgtgtgtgtttgtgtggtgtgtgtgtgtatttgtgtgtggtatgtgtgtttatgtggtgtgtgtatggtgtgtgtgttgatgtgtttggtgtgtgtttgtgtgtgtgtgtgttgtgtgtgtttgtgtgtgtggtgtgtgtttgtgtgtgtgtgtgtcttcttgctgacataccacctaaaataaacccaagatgggatgcaccacatactctgaacccttgtcgggtggtcaatgggtgttcaggacatcccagcagaggaagggagacacaccagcctgtcctggcctgggtgtgcagccagaaagcatggggccaggctgggcaacacagtgagacctcctctctacaaaaagtcaaaaaaattagctgggcgtggtgctgtgtgcctgtagtcccagctacttaggaggctgaggtgagaggatcgcttgagctagggaggtggaggccacagtgagccatgatcgcgccactgcactccaacctgggtgacagagggagaccctgtctcaaaaacaaaacaaaaacaaacaaaacatagagcattaggcagtccaccacgtgtggaggggcagtgcagggcaggggtataggagggcccatccaagcctctgtgactttggccaccatctttccttcccctagcctgtctccccaggtgagtttcacccccaggcagtccttagagacccgccacccaatttacccttggccttgagtttaccgttctctgttcttccaggttctgccgcccacaggctgtttcactcatcctctccaccgggtgccctgcggaggtgtgcaagtgtgatatcatcaaaggctgtgaataagtaaacaataagtggccagaagtggcctgtttcccacatgatacccagggaagggtccgattccccccgcctgggctctggggcaagtcctggctggcgtgccagagcatttattatttagtatttttacttacctgtcccaggttagggactgtcccaagcaatgccagtcccaccctctatctgcacaccagaaaaagctgagggcacagcaggtgattggagtcagacagctaagggtccaatccctttcttctcacatagactggctgtgtgaccttggccaaatttcacaacctctctgagcctccactgagcacacaccaagtcccattgccaggcctaagtcctgcttctgccagtcactagcctggcatccttgtgcaagggattcaactcctctgagccttgggctcctcatcaatgaaacagcagcacctctacctggggctgctggggtgattaaatgagatctgtgtaaagcacagttgctatacacatacgcattgtgatattcattaatagtcattcaaaatgtatatatttagagatgagatctcgatctgtcgtccaggctggagtgcagtggcatgatcatggctccctgtagccttgaactcctgggctcaactgatcctccctcttcagcctcctaagtagctagaattacaggcatgagccaccatgccctgcctgttgtgtcatctgtctgtctgtctgtctgtctgtctgtctgtctatctatctatctatctatctatctagcgcaatctcggctcattgcaacctctgcccccagcggtcaagcaatcttcccacctcagcctcctgagtagctggggctacaagcatgtgccaccgtgcctggctaatttttgctttttggttttgggtttttttctttttttgagatggagtcttcctctgtcacccaggctggagtccagtggtgcaatctcagctcactgcaacctctgcctcccaggttcaagcaattctcctgcctcagcttcctgagtatctgggattacaggcacgtgccgccatgctcggctaatttttgtatttttagtagagacagggttttaccatgttggccaggctggtcacgaactcctgacctcaagtgatccgcctgcctcggcctcccgcagtgctgggattacaggtgagagccaccacacccagcctaatttttgtattttttgtagagactgggtattcatcatgttggccaggctggtctcaaactcctgacctcaggtgatccacccgcctcagcctcccaaaatgcagggattacaggtgtgagccactgtacgtggcctataattttttttttttttgagatagtgtctcactctgttgcccatgctggagtggagtggtgtaatcatagctcactgtagtctcaaactcctgggctcagccctggcgtggtggctcacgcctgtaatcccagccctttgggaggccaaggcgggtgaattacctgaggtcagaagttcaagaccagcctggtcaacatggtgaaaccctgtctctactaaatatacaaaaattagctgggcgtggtggcgggtgcctgtaatcccagctacttaggagactgaggcagaagaatcgcttgaacccagaaggcagaggttgcagtgagtcaagatcgcacaactgcactccagcctgggcaacaagagtgaaacttcgcctccaaaagaaaaaaaaaaaaccaccaccaacaacaacaaacaaaaaaactcctgggctcaagagattcttccacctcagcttcccaagtagttggaccataaatacacatgaaaattagaaaacatgcatgtctaatttttcttttttttttgtagagatggagttcactatgtttctgaggctggtcttgaactcctgggctcaaccgatcctttcacctcagcttcccaaagtgctgggggattgcaggcatgaaccactgcacctggctatatattttaatgagccttcattctatgccatgtgccttgcatacattttctcaaataatcacagaaagccctgccagtccctgagggttatccccactttccacatgagtacaactgaggctcagtgaggtcaattgacttgtccagggttgcacagatatactgtggcagaactagaattcaaatccagatctttcctggttctaaaggctttttttttttctcgcccaggctggagttcagtgacatgatctcaactcactgcaacctctgccctctgcctccccagttcaagtgattctcctgcctcagcctcccgagtagctgagattacaggcatgcaccaccacgcccagctatttttttttctttttgggggcggagtctctgtctgtcacccaggctggagtgcagtggtgcgatcttggctcactgcaaccttcacctcatgggttccagcaattctcctgtctcagcctcccaagtagcttggattataggcacctgccaccatgcccagctaatttttgtatttttagtagagatggggttttgccatgctagccaagctgatctcaaactcctgacctcaggtggtccgcctgccttggcctcccaaagtgctgggattacaggcgtgagccactgcactggcctaaaggtttttttcgttttgtttccaactgggccattattatttccaacctataagatggaagtaattgtttctgccactcgtgcctcctgtaaggattaagtaagataaagtctgtggagaggcctctgttgacaccagctctagctcagcactgcttctttattcccccagggtaattacctaaacacaagcctttcattttatactaaggaggctggtgaacctcttcttaatctctgggagatgatatcgttggatgtccattggaggcagctgaaagtattagatcagaatcagaactgccaggtcccttcccacgtccaagcctgctgaagcttctttcatcttctgggaactctgcatctctgatctcccacccaccccacgattattggaagtatacaatcctgtctgccctttcctaggggaagtgcggaactacatatgatacatctgacatctccagcttccaacttcgggagaggagactttgcggttagctggctattgtgaagtcagtttttctctgcccccagcaaatgttgtgatgtggatagaagtggggcctcggcacagccaggcgcagtagctcacatctgtaacccagcactttgggaggccgacgtggacaaatcacaaggtcaggagtttaagactagcctggccaacatggtgaaaccctgtctctactaaaaatacaaaaattagccgggcatggtggcatgcgtctgtaatcccagctatttgggaggctgagataggagaatcactcaacttgggaggcagaggttgcagtgcgctgagatcgcaccactgcactctagcgtgggcaacagagcaagactccatctcaaaaaaaaaaaaaaagagaaagaaaagaaatggggccttggcaaagtggggtgcatacatcatcccttgtcttggcttgcctggcaacacacaagcctggggcactgcccgtgctcctgcataatgtatgagcccatggtaggaacaaaacaccagcaccagcgagtctgggcactgcaggccacggacgtgtccaggggccttgccaaggctgaagtctctctgttggcagaatatgcagaatatgtgttcctggaggccttttgtagggctgaggtgagaactggcctcaacttggtcctcaggattccatcagacaataagaccgcccaaggccgggcacagtggttcacgcttgtaatcccagcaattcgagaggctgaggcaggaggatcgcctgagcccaggagttcaaaaacagcctgagcaatacagtgagaccccgtctatacaaaaaattttaaaaattagctgggtgtcgtagcatgcacctgtagtctcagctacttgggagactgaggtggaaggatcccttgagccaggaggtcgaggctgttgtggtgagccatgattgtgccattgcactccagcctgggctaccgagtgagactctgtctcaaaaaaaacaaaaacaaaaacaaaaaccggaagacagcctaagaagacaatcttctttaggatcaataatggtgacattagcaacagctagacttctgttttctgggcttgaaacgccctctgagagggccaggggtggccaagagggtggctgagaccacctcagtatggttgacagtgggagggaagatttggatccagggacacagcccctggcagtttccgtggctgcctcatggtgtaggaaaccccaggagcagcagctgtggtgaggtatgttggggtggagaacatggacaaaaataggtatatggtggcattgtttttaggggaaaatgccaggattcagccatcgtttaggaagtcggaggcctccatagagaggggtgcttgtgtgagcgtgcatgtgtgggtgtgtgcaagtgtctgtgtgtgtgtgatctaaaaaggttaggaatgaaacggggaggtctgagtgccttgaaagccaaggaaattaggacgtgtggaaaacaatgcttcattcgtggatggtgtttggtttcaattcattcatagaatcagtgagtattggctgagtgcagtggctctggcctgtaataccagcaacctgggaggccgaggtgggaggatcatttgaggcaggagttggagactagcctggccaacatagtgagaccccatgtctactttattaaaagaaaaaaacaggccaggcgcagtggctcacacctgtaatcccagcactttgggaggccaaggcgggcagaacacctaaggtcgggagttcgagaccagcctgaccaacatggacaaaccccgtctctactaaaaatacaaaattagctgggcatggtggcacttccagctactctggaagctgaggcaggagaattgcttgaatccagggcggaggttgcagtgagctgagatcacaccattgcactccagcctgggcgacaagagcaaaactccgtttcaaaaaaaaaaaaaaaaaagaaaagaaaagaaaaaagaaagaaagaaagaaaaagaatcagtgagtattcaccaaggctcccagggctaggccaagtactagagctcaggatacggagatgactcagaccaggccccagacacttgcagtctaattgtggagccagacatggaagtgaggaattcaagtatcttgtgagaagtgcgagaacaacagtatctgtaggatgctgtgggaattcacagtccaaagcagccacctctgcctgaggttggcagggagacctcacagaggcaaaactgaggacgtgcttgagggatgaggaagaggtttgaggggaagacagagggtgttccaggcagagggatcagcaactgcaaagctgtggaaatgtgagaccctacacactggttcaggaagcttcagcagatcctactgaaggtggcttatgcctgtaatcccagctacctgggaggctgaggctggaggactgcttgagcccaggagttcaagaccagccttaacaacatagcaagaccacatctctaaaaattcagaaaaaaaggctgggcacagtggctcatgccagtaatcctagcactttgggaggccaaggcgggcgggattgcctgaggttaggagttcgagaccagcctggccaacatggtgaaaccccgtctctactaaaaatacaaaaattaggtgtgcgtggtggcagtcgcctgtaatctcagctactcgggaggctgaggcgggagaatcgcttgaacccaggagacataggttgtagtgagccaagatcacaccattgcactccagcctgggagatgagcgaaaatctgtctccaaaaaataaataaatcaattaataaataaatcagtaaaaaagaaccgggcccggcgcggtggctcacgcctataatcccagcactttgggaagctgaggcgggcgcatcacttgaggtcaggagttcgagaccagcctggtcaacattgcgaaaccctgtctctactaaaaatacaaaaattagccgggtgtggtagtgcgcgcctgtaatcccagctactcgggaggctgaggcaggtgaatcacttgaacacgggaggcggaggttgcagtgagccgagatcgcgccactgcactgcagcctgggcgacagagcgagactccgtctcaaaaataaataaataaataaataaataaataaataaataaatataaataaaatataaaaagtagcattgatgtttacaatatccctgagcggcaggcgtttctcccttttgcagatgctcagtggcttggccggagatacatccaagtggtgggtgtagcctgggggttcaatcctcctgtggcgccccagaacccggtgcctcctccaacgtccggcatctgatgaggatccgacccaggcgggcggcggcgggattcgctcttccccttcgctccccgcgagaaagccccgagggccgcggcggcgcagagccggtgacagttgaagcttaggcgggaagagggaggcgcgaggcgggaagagggagtttgggcctcggcagccgccgtacaaacaccgctctggtcaccatggcaacagcgggatgccgcgaacggcttctgggcggggccggtccctcggacgattggacctagcttggcgcggaatccgtgaattgcccgcggcccgagggtgcaggtgatgggtgctgaccgactggggaagcccggagtgtggggactgaggaggggagtggcctggggcgcgctggagcctgcgaggaaggcgccgcctcggatcccccgccccccattccccttcccgaattccaccctccggcccagccatggcctcagtttccccaaacaggaaagggaaggagggtgggcaccccggtctaacggtgcctctcagcctctgagacccagaaccttccttctgcagctcccggactgactggctctgcccttccccatggacgtaagtccgggccccttcccctctctgggccccctcagcgccctctcctaaccccgaatgggcctgtcttccagcacggactggggagggggcttctacccaacagagactacaacctgccagctcaggacgagagctgtcaggaagagtccaggaatggacttcccacgggagggcacatttctggtattcctggcaagataaggagttgactaagtaatccacgagaaaaggcatttccggcagaggaaacagtctgggggtgagagggaggctgcagcatttggggaactgctagggctatcgtgtgtttggaagagggggagggagagaggtaggcagggctaaattgggaattttgtcactgacataaattttaagtgccaggcgtggtggctgtcgcctgtaattccagctactgaggagactgaggtgggaggatcgtttaagcccaggagctcgaggctgcagcgagccatgatcatgccgctgcactccagcctgggtgacagagtgagacactgtctctaaaaaaattgaccaggtgcggtggctcatgcctggaatcccagcactttgggaggccgaggcgggcggatcacctgagatcaggagttcaagaccagcctggccaacatggcaaaaccccctctgtactaaaaatacaaacattagctgggcgtcgtggcgcgcacctgtaatcccagctactagggaggctgaagtaggagaatcgcttgaacccgggtggcagaggttgcatgaaccaagcttgccccactgctccagcctgggtgacagtgatactccgtctcaataagaataataataataaaataaataatagaaaaagttttaagtgagttactgggagccattgacggattgtaagggagggagggatactacacaaggacatctggtgtggaaaggggcaaaattgcaggttggatgacaggagccggtaatgtgggctgagggatggtaaaggagtggcaagggagtcagagacaagagatctctttggagaggcattccagaaggaaaatcagccctagaagactctagaatgctgaagtgcttgatgttgctgaactgggaatgatagggaaaaaggcaggctcagggcacaagataatgagtcagggtgtagtcctgttgacgctctccccaccatctggtggccgttcctctcccagccacctcctcgtccctcatggtattcccgtgttcctgcagcccctctccatctccttgtcaccccttcctcctgtactcgtccaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggtgaggggtctggtcggggataaagggtgggctctggggaagaggaatcccggtaacctgtcccttcatctgcaggctcttaccctgagacacttgacatttagcccttgcatctatccgttttgtggtaccagggggtccctcctctcctgtccccagccaaaccttttcctttcccctcgggaaagctgccttggctgtcactacctgctgcctattccacatcctgaaccctgtgacctaggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgtgagttccattcctaccccctgccccactgagccctgatctaggtatgatcggtgcattcatttttttgctcaacaacatttattactgagcaccttctcaaggccaggcacggttccagggcatgaatcatgtgcagccaggtaaaaacaacctatcagataatgcctggtgatgaaagctacttgaagaaaataaaatagggtgccagctggagaaaggtgatgtgggtaacatgtagagtacatagccagcacttctaaatgaaagtgagctaaatgaaagttagctaaatgaaaaaacagctcacacagctcctttccgttcaccgaatgaactgtgttctaggtatagggcctctttacggacctttgtttttcccaacaaccctgagaactgagaactaagttgtttttttttctttcctccctccagagctgggtcctcccgtctcctcccctcccctcttcttttctttttgttgttgtttgagacagggtttcactctctcgcccaggctggagtgcagtggtgcgatctaggctcactgcaacctccacctcccaggctcaagtgattctcctgcctcagcctcctgaatagctgggattataggctcacacaactaccatatggctaatttttatatttttagtaaagacggggtttcatcatgttggccaggctggtctcgaactcctgacctcaaatgatccacccgccttggctgcccaacgtgctgggattacaggcgtgagccaccatggcccagccatggttttttttttttttttttttttgagacggagtctcgctctgttgcctaggctagagtacagtggtgtaatctcagctcactgcaatgtccacctcctgggttcaagcaattctcctgcctcagcctcctgagtagtaggaatacaggcgtgtgccaccacgcccagctaatttttgtatttttagtagagacggggtttcaccatgttggccaggctggtctcgaactcctgacctcaggtgatccagagctgggtattttttaaaacctatatgttttttctgattacaaaaagtattatttacaaagtatacatatagaaatacatggaaagtaccaatcactttacaaacccgctctctatcccaaagttgctgtgttttacatgtatctctcatatactaatacagtactatcactgctgtattttaccattatttggcaaaaatggggtggtatcatgtaggttatttcatcatacctgctactgtccccctatcccccgccttttttgagacacgatcttgctctgtcacccaggctggagtctggtggtgcaatcatagctcactgcagcctctacctcctggactgaagcaatcctcccacctcagcctcctgagtagctgagactataggtgcatgccaccacacccagctaatgtttatatctttcacacagatggggtttcatgttgttgcccaggctggtgttgaactcctgggctcaagcgatctgccatcctcagcctcccaaagtgctgggattacaggagtgagccaccatgcccagcctctacttgccctttttttttttttttttgagacgagtcttgctcttgtcacccaggctggagtgcaatggtgcaatctcggctcaccgcaatctctgcctactgggttcaagctattctcctgcctcagcctcccaagtagctgggattacagggatgcgccaccacactaggctaattttgtatttttagtagagacagggtttctccatgttggtcagggtggtctcgaactcccgacctcaggttatctgcctgcctcggcctcctaaagtgctggaattacagatgtgagccaccgggctcagcctctacttgccctttttaacctgacatcacacttcgccacctatccatgcctgtatgtgtagacacataagggttactgtcctcctcctgaagtggggagtaagctggcttagggaagtttagtggcttctccagagtgttacgcaggagagccttgcatcgcaaatagctccacagcgttagctgaggtagaatcctcaggggagaagcctggcttggagaagacaacctgtttctatttgtgggtttaaagatgttaaatgtaatcgaccaccgtcctgaggaatgattattttgagctcagcgattcagacagcaaagcccctgcccttggagtggtgacattccttccctaggatggaaggggaggataaaagcaaattcataacttgggcatatggtgattggtgctaatccctggcatgttttcagttttgaagtaaattgtggggcaaggagcgctttttcagataatcaccttctggtttgccaggggcagtcagcagaggggtctcaggtttggggctgaggggcagaagggcaaaaggaggagaccttgggttctgaaaactcctgtcttggcgtggtggcactcgcctgtaatcccagctactggaaaggctgaggcaggagaatagcttgaacccagtaggcagagattgcggtgagctgagatcatgccactgcactccagcctgggtgacagagtgagactctgtctcaaaaaaaaaaaaccaaagcaaaaaaacctcttgccttagaggagatgctccattagaaaatgatttctggccccctgtcctggggatgccgccccctaccccttctgtctatttgaagtgaatagccagggactcatcacctccttgggagagaggatgggtgaggtgcattgtaaggatagactgggccttcccaccttccccacagagggctgcaagaactttcaaacctggagacatcaggccctgatcctctctggtttctgctggagctaggaagggatttaacagggtggaggacagggcaggttctttctgtccttgagctgtctttccacaaagtatatttaagtccctccctcttcagtttccttgtaataacagcccagaaggttacaaatgtcttgccacttggcagctgtagacactgaggcttacggaggttggagtgacttggaggttatatggctggatcagctggaatagaaacccaggtttctcttccttactgagggagaaacatgcctgctcgcctgctctgcttcttttttttttcttttttcttttttttttgagacggagtcttgttctgtcacccatgctggagtgcagtggtgcaatcttggctcacttcaacctccgcctctcgggttcaagcgattctcctgcctcagcctcctgagtagctgggattacaggtgcccgccaccacacctggctaattttttgtatttttagtagagatggggtttcgtgttagccaggatggtcttgatctcctgacctcgtgatccgcccgccttggcctcccaaagtgctgggattacaggcgtgagccaccacgcctggcctgctctgcttctttcatgtgcatgttgcaaggttctcattcattcattcattcattcattgactcactcaccaaagatttatggagttactgttgaggcactgtctagggccttggggactcagcagaaacaagatggagaaggtccccagcctcgcagggcttccattctggtgatggagagagagaaataaccaggccattacaacagagggtgagaaatgacgtgctatggagcagcggttgctcagccctgcatgcgatcagaagcaggtataggacttaaaaggaaagccaggcatctaggccccacactgaggtctgggctggggctagagtttgtgaatcttttacaagttctcatatgattctgatgcacacaggttaagaaccactgctgagggaagaagctatgataagaatagctctctttcaggccgggtgcggtggctcatgcctgtaatcccagcactttgggaggccaaggcgggcagatcacaaggtcaggagttcgagaccatcctggctaacacggtaaaaccccgtctctactaaaatacaaaaaaaattagccgggcgtggtggcgggcgcctgtagtcccagctactcgggaggctgaggcaggagaatgctgtaaaacccgggaggcggaccttgcagtgagccgagatcgtgccactgcactccagcctgggagacagagcaagattccgtctcaaaaaataataataataataataatatctctctttcttttttttttttttcccaggcagggtctctcttgtcacccaggctggagtgcagtgctccctctgttgcccaggctggaatgcggtggcgtaatctcggctcactgcaacctccgtcccccaggttcgagtgattctcctgcctcagactcccaagtagctgagattacaggcacctgccaccatgcccggctaaagtttgtatttttagtagagacaggttttcaccatgttggccaggctggtcttgaattcctgacctcaggtgatccacctgccttggcctcccaaagtgctgcgattacatacaggcgtgagtcgccatgcccggccaagaacagctctctttcgtccagcactcattacttaccaggcatcgtgcttagttccttccaccgattcccgacaatggccttatgaactaggtcttatattttttcattttattttattttattcttttgagatggagtctcactctgttgcccaggctagagtgcagtaaaacaatctcggctcactgcaatctccatctcctgggtttaagcaagtctcccacctcagcctcccaagtagctgggaccacaggcgtgcgccaccatgcccagctaattttcgtatttttaatagagatgatgtttcaccatgttggccaggctagtcttgaactcctgatctcagatggtgcgcccaccttggcctcccaaagtgctgggattacaggtgtgagccaccacacctggccttaggtgttatattcctataaatgaggaaactgaggctgaaaaaatgaattagccaagctgaggttcaaacccaggccttactgactctagggcctgagctttaaccatctatacgatgatggctggctctcacagagacaacaggaaaaattcaagtgaaaaactctcctgagagccaggagagacacaagggttaacagtcttgcggagtccttgtttaatgtacttaaacagcagattccttccagaagccacatggctgcttgtaacggttgagaaatccattagccagttattaatgacaagatctaaacccttccaagggagagagccaagaaatgcttttaataccctcttttctgaggtaatggcagcagagcctctctcagccatgggttctgtgcacagaatgatggtgtggtccttcaaaagcccgcagaagtgatttcatccccagactgagactccctagagacaccccaaatcacaccctcatcaaacacaagaaaatcacttctctctcccccttccaccatgacggttctagcctcccccaaggaggcagttctgttgacagtagcacagcccaattcagacccctgtccctgcaggtggcaggtcccctcccctcactgcagcccctagtgatatctgatctcaccagccatctgacaccacaccctgaaacctcagctgttggaaaggtcattcccctattcctggcttggccaagtttctgattgaactgtacaactgtgactgtcactacctctgcctctggcctcaaggagccaatcttctgtcacacagccatcctgggccacttcagccatttggcctgactccagcccatgcctaaggcagttgcgggtcatccctgtcccaggggaggacagcagtgcactggatagaccagttctcccttcttgtctctaaggacacgctgctcctattccccaaagagacagacattgtttcctccaggagctgagaagccctcttctttcttctttgcctaaagaaggcaaatgatatgcttagattcatccattcattcagcattcatttatatctcagacacctgctgagcatgagtccagtgctagctcagtggagaatatgggatgagctgcccctgccctggcagacccagagagaggctgatgctcctggcactgggaggcagagggctcaagagggattgcaggcaggactgtacatcccagctccattcccatcacttgcctctctgtctatgcctccatttcctttttttttttttttttttttttttttttgaggcagagtcttgttctgttgcccaggctggagtgcagtgggtcgatctcggcttactgcaacctctgcctcccaggctcaagcgattctcctgcttcaggcttctgagtagctaggattacaggtgcaccccaccacgcccagctaatttttgtgtttttagtagagaagaggtttcgccatgttggcccagctggtcctgaattcctgaccttaagtgatccgcccaccttggcctcccaagttgttgggattacaggcatgagccaccatgtctaaccatccattttctcttttgtaaagaagcccattactcaggattctggtaattaaaaaatataaggctgggcgcggtggctcacacctgtaatcccagcactttgggaggccgaggtgggcggatcacctgaggtcaggagttcgagaccagcctgactaacatggtgaaaccctgtctctactaaaaatacaaaaattagctgggtgtagtggcgggcgcctgtaatcccagctactcaggaggctgagacaggagaatcacttgaacccgggaggcagaggttgccccaagctgagatcccaccattgcactccagcctgggtgacagagcaagactccgtttgaaaaaacaaacaaacaaatagatctaattcttttgaaaacattaaaattgattgggcgcagtggcgcatgcctgtaatcccagcactttgggagaccaaggtgggtttagcccaggagtttgagactagcctgggcaacatgatgaaaccctgtctctacaaaaaaatacaaaaaatgaattagccaggcgtggtggcacgtgcctgtaatcccagctacttgggaggctgaggcaggagaatcgcttgaacccaggaggcggaggttgcagtgagccgagaccgcgccatggcactccagcctggcaacagagcgagactccgtctcaaaaaaaaaaaaaaaaaagtacaaaaaatgagccgagcacggtggttcatgcctgtaatcccagcactttgggaggccaaggcgggcagatacctgaggtcaggaattcaagaccagcctggtcaacatagcgaaaccctgtctctactaaaaatacaaaattagccaagtgtggtggcacatgcctgtaatcccacctacttgggaggctgaggcaggagaaccgcttgaatccagaggtggaagttgcagtgagtggagatcacgccattgtgctccagcctgggcaacaggagtgaaactccatctcggaaaaaaaaaaaaaaaaatggccgggcacagttgctcactcctttaatcttagcactttgggaggctgaggcaggtggatcatctgaggccaggagttccgagaccagcctgaccaacatggtgaaacccccatctctactacaaatacaaaaattagctgggtgtggtggctcacgcctgtagttcagctactcagaaggctgaggcagaactacttgaacccaggaggtggaggttgcagtgagccaagatcgcaccattgcactccaccctgggcaacagagtgagaccctgtctcaaaaaaaaaaaaaaaattaaaaataggtaaattgccattttcaaagatacctgtaaagatttttaaaatcattcatgaatgcggtctgttcgttgcacagagtagatgctcaaaaatggtgaatgagaccctctattttggtctcatgctgaagaagtccataaagcccacaagtcattttcatgatggacagaaaaatgtgtgtgctttctctgtctactgcctcaactgcacagaccccgggactgtagcagaaccatcttttgagcttgacaccgggaggcccaaattctagcacgggacccagggccagttgctctctggtcctcagtctcctcacccataaaatgggaaggagagaaccctgaatcattgcttctagcttctgaactcagttgttcagaacaaggactcactgctgatttttcaacagcacagggaattgcactgttcctgggaatgatggacagtaccctctgttccactgggcaagtgagatttcccaggcctctctgttcccttctccccttagagagcaacagacgtggccccatcccacctccctcaaccctctctctcctccctcaggactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtgagtgtagtgccagtatctactctccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggtgagtgggcaggggctccctccccatcaatagggccgacccaagtcttcctcccccttcccccatgccgggccccacgatagtgtgaatgtcaggggcttcaggtttccctaaatataggtccctgccagaggatccgtggcgggaaaagggcaggggtcattagagaagatcggggacacatgtggggcgggcaggagctgccttataaccagcccgggaacccctagctcactcgctgctgaccaggctctgccggctccttcggcctcgccgcaggtgggccccttgcaggaccgggccggggtggggatggggttggggttgggccaacagggtccagatggggtccaggtgaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggtagcagagcccagaagaagaaagagcccctgttctctgttttttctgggcagaaaaggagtgaaaggtggaaggaccttcctgctctgttttatacttggccagggcttcaagaaaggctgagagcttgtgacattttcttccagccactgcaggctctgccccttcacctaacagcataagatagggctaacagttggggagtatggttgtaactgctcatgtcttaggaggcttcagcctcagcacttttaggtccagaactcaaggggggcagaagacccctgtgacaaaaacccactaactagctcatgagtgacatgagccaggcaacataatgggtgttttatatgagtagatgctgttatttttaatttatacctaaggctcttttgcccaagattgaactgtttcttggtggaaaggattatcaatgcatatctcttttttttttttttttgagacaatctcactctgtcacccagactggagtacagtggcacgatcttggctcactgcaacctctgcctcctgggctcaagcgattgtcctgcctcagcctcccaagtagctgggattacaggctcacgccactatcgcctggctaatctttgtgttttttagtagaggtggagtttcatcacattggccaggctagtctccaactcctgacctcacatggttcctccacctcagcctcccatagtgctgagatgataggcgtgagccactgcgcccagccaatgcttatctccttaatctacactattgagttttctgttttcccatctttttttttttttctttttgagacagtttcgctcttgttgcccaggatggagtgcaatggcacggtctctgctcactgcaacctccccctcccgggttcaagtgattctcctgcctcagcctccacagtagctgggattacaggcgcaagccaccacacccggctaattttttatttttagtagagacgaggtttcgccatgttggccaggctggtctcgaactcctgacctcaggtaatccgcctgcctcagcctcccaaagtgctgggatgataggcgtgactgcgcctggcctgttttcccattttaacaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatctctgcagtgattcaggtagaacggagttacctagaaccttctaggagtataaaaacttggtcctaggccgggtgcggtggctgacgcctataatcccatcattttgggagaccaaggtgggcggatcatgaggtcaggagtttgagaccagcctggacaacatagtgaaaccttgtgtctactaaaaatacaaaaattagccgggcatagtggcgcacacctgtagtttcaactacttgggaggcggaggcaggagaattgcttgaacccaggaggcagaggtaatggtgagccgagattgtgccactgcactccagcctaggcaacagagccagactccgtcccaaaaaataaaaataaaacttggtccttcccttttctgcttattttgcttttattgcttacatctaaaacaaaaccaatcactattatccctctaaactttggattaatttgtctgcctagctcattcaactctgggaaacaaacactgaagtaaagcaaataaaaattgaaggtcggtagaagatggcaaagggggcattccaaaagggaacatgtgcagagtctcagagactggagagattgtttaaagatcaatagtttcagccgggcacggtggctcacaactgtaatcctagcactttgggaggctaagtccggcggatcacgaggtcaggagttcaagaccagcctagccaatgtggtgaaacccccgtctccactaataatacaaaaattagctgggcatggtggcgcgcgcctgtagtcccagctactcgggagactgaggcaagaagagtcgcttgaatctaggaggtggaggttgcgctgagccaagattgtgccaccacactccatcctgggcaacagagcgagactccgtctcaaaaaaaaaaaaataaaaaagactagagaagcagagaacgtcatataccagtttgggggatttggacttttatttatttatttattttgagacgaagtctcgctctgtagcccaggccggagggcagtggcacgatctgggctcactgcaacctctgcctcccgggttcaaaccgattatcctgcctcagcctctccagagtagctgggattacaggtgcacgctactgcacccggctaattttttgtatttttagtagagacggggtttcaccatgttggccaggctggtcttgaacccccaatctcaggtaatccgcctgccttggcctcccaaagtgctaagattacaggcgtgagccaccatgcctggcctggacctcttaattttatgataatctgagttcccgaaagagtaattgatagaaaaaaaaactacacctgaggacacaactttctgagttcaaatttctttttttttgagacagcatttcactctgttgtccaagctggagtgcggtgtcacaatttcggctcactgcaacccccgcctcctgggttcaagcgattctcctgcctcagcctcccaggtagctgggactacaagcgcatcaccaaacctaattattattattttttattttttaggatagacagggtttcaccatgttggtcaggctgatcttgaattcctgacctcaggtgatccacctgcctcggctgcccaaagtgctgggattacaggtgtgagccaccacacacagccaggttcaaatttctttcttttttttttttgagacagagtctcgctctgttgcccaggctggagtccagtgacgcaatcttggctcgctgcacgctctgcctcctgggttcacgccattctcctgcctcagcctcccaagtagctgggactacaggcgcccgccaccacgcccagctatttttttgtatttttagtagagacggggtttcactatgttagccaggatggtctcgatctcctgatctcgtgatccgcccgcctcagcctcccaaagtgctgggattacaggcgtcagccaccgcgcccagcccaagtttcttattctttttgtttatagactgggtctcactctgttgcccagcctggtcttgaactcctgggcttaagtgattcgcctcggcctcccaaagtgctgggattacatgcttgagccaccacacctagccccggattcaaatttcagtgtaacatccccaatccactgttatacaagcaatgaacaagttatttaacccctctgagccagtttcctcctcttaaaaaaggcacaaaacttaatagaaagcaactaagaagccaggcacggtggctcaagctggtaatcccagcactttccgaggccgaggagagtggatcacctgaggtcaggagttcgagaccagcctgaccaaaatggtgaaaccccgtctctattaaaaatgcaaaaattagctgggcgtggtgacgggtgcttgtaatcccagctactcaggtggctgaggcaggagaattgcttgaacccaggaggcggaggttgcggtttgccaaaatcgctccactgcactcccgcctgggcgacaagagcaaggaaggctctgtcttaaaaaaataaataaatgaaaatacaaaaattagccaggcgtcgtggcacatgcctgtaatcccagctacttgggaggctgaggcaggagaatcgcttgaacctgggaggcggaggttgcagtgagccgagattgtgccactgcactccagtcggggtgaaaaagcaagactccgtctcaaaaaaaaaaaaaaaaaaaaaaaaagaggccgggcacggtggtacacgcctgtggtacagcactttgggaggctgaggcaggtggatcatgaggtcaggagatcgagaccatcctggctaacacggtgaaaccccgtctccactaaaaaatacaaaaaaattagccgggcctggtggcgggcgcctgtagtcccagctattcaggaggcagaggcaagagaatggcgtgaacccgggaggcggagcttgcagtgagccgagatggcgccactggactgcagcctgggcgacagagcgagagagtgagactctgtctcaaaaagaaaaacggaagcaactaagaaatgtcaagagtgccattttggaatcagagaagtcatgctgactgaggcacaggcttggcgtgggaaaagtggactccaatctgttaacttctgaagttgtccacggcaaatatttctctgacggcacaggaagagatctgaacttggcttccctcatccattgaacaagtattaacaagtatctatatatgcctaccgtgccaggccttattctaaccactggggctgcaatatttaaaaagacaaagttggatcctccaaggactgtggtggggaaggctgacaaaacaagtaacaaaaatgtgtaacattaaaaaaaaagtgtaatgttaaaaaaaaaaagtgtaataaagttacaaagcctagccccagctcggcttgtttccctagctgaaatgggggatggccgggcgcggtggctcacgcctgtaatcccagcactttgggaggcccgaggcgggaagatagcttgtgcccaggagttcgaggtcacagtgacctatgatagccccaccgactccagcctgagcgatagagcgagaccctgtctctaatttagaaaaaagaaagttgtggccgggcgcggtggctcacgcctgtaatcccagcactttgggaggccgaagggtggtggtgggtgggggcgcggatcacctgaggtagggagttagagaccagcctgaccaacatggagaaaccccgtctctattaaaaatacaaaattagcccagcgtggtagcgcatgcctgtaatcccagctactcaggaggctgaggcaggagaattgctggaacccgggaggcggaagttgcggtgagccgagttcgtgccattgcaccccggcctgggcaacagcaaaactccgtctcaaaaaaagaaaagacagttgtttaaacatttttatgaaatgatatgggaggggactggtctagggtttctaatagcctccacatcgcccagcggcagagcccacaaaactgccactggccgccaccgggttcctccacctccttcccgatctcaggctggagaagtggtgcaggggtcgctgcgaaaggagaggagcgtgtatgacgccacatccggcgcgcggcggaactggcctcctttgcttccgcggcggggccggaagtaggagcggcggcggcggcggcggcggcggtcgaaagcggagtgaaagagggaggcagggagccggagagccggaaccggagtcgcagcggcggtaatagtgcgagactcctctaagtcaccgtccttagcgcgggaccgcggggttcgacgggagttagcgggggtgcggccaggccgttggacgccggggggtcctggggccgatgtgaggggaggcgggggtgggggagccgggccggctctagaatcgagttgtccgctccgagccccggacggacactgatccgcgggctcgtcttggcctttcccaggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtgagctcgttggccctggggaagggaggccaagccgccgcccacgggttctggcctggggcaaacccaactgagaactttgggcttgcctcgttctggaagctttcccagagaggagcaggatggagccgctgccctcgaggaaaagctagcctgctcggggaagacagagtggataaagacacttaaagtttattagacgatgtgtttccagtggagtaagagtgttacataaagtacttaggaaactcaaggaaacaagtccatctgtcgggggacggaagcttgttggaggggggccgaactgtgggagaggcctcgaataaggaggtggtaaaagagtcagccaaaaaccaaaagtttaagacaggaaagttaaagaccctgtgatttataaaagtcttctaattacaacaacccttaaagattggtggtattgtactcattttacaggtgggaactttcatgttcaaagttacccacaagtaaggaatggggtctgaagccagctcttagtgtcctgtcctttttcaggccataatgcaaaaaggtggagttggatcattcacgttcagggtgggagcctgagaaatcgtagcaagtaagccagggtagaattaagcacgatagggaggccagttcagagttctgtgggaagtaggatgatgtagtggttaaggctctaggttttgcagtgtgagatggctctaggtttgaatctgaactctgccgctttctagctgtgttagtaatcttaagtgtctttatttgtaaagcagaattaatagtacttaataagatgattgtgaagattcagtgagttggtgctggagatgaggttagcacagtgttttggtacagcatacgtgcttgataatcaccaggtattctatttcttttggaagagggcaataatgagatgggctaaagccatcagggagggcttttgagtggaggtaggccttgaaggatgaagataatttggctagctgatggaggcagggccagtgagggaagggcattccaagcaggacgaatgtaacagtggaggccctgagatgcgtggggaacagtcaggggtttaattacctgcctcctctggggaactgtgtgattgtggcttctaccaggctggagaattgtggcagaagagcccacagaattaccctacgtttattgaacagtaaacattggcctttacagggccactatttggcctggcccggtactggcaaaaaacttctatccatctcttccccccagcaatcctatgaggttggaatcatttgctgcattttatcgaataggaagccatgactcgtagaggtctggtgacttaactgaggtcacccactgaggacgtggcagagctgggtcctgaatctgtggccctcaggctctttgcctggccctgcctcacatagactacctgcagccagacagggcctgtgaggggatgatgagcagggtcggcctctttttcgccacctgtctgtggcttttctcttttgccagctgaccagaccagccccatggtgtttttagttgtcccctttccctcagtcctgattggcatttttaggaacttaaacctgttgttgcctggcactattctttaacctcgaagtattgtctccctcacgggccctggatcagtgtggtggtgatggtagacaaagcttagatagcatgctggagtttgcagaatagcaggaagtcgtatattcagtctccatggctccttgcaacagcctaaggaatacgcagggtgggctgagtacttagccccatttcatagcagaggaaactgagcctttgagtagataatgtcttgcccaacatcacgcagctagtcggaggggaagttagttttgcatccaggtctttgactgtgctccgtggtcactgagagccaggcagaggcatttagattttgatgtggggtgtgaggcagcaggaagccatggaaggctgaggggtggagggtcctgcccagttgaaactgagtggaactaggaggtactaggccaaggcctgagttggccgctgttgtcccaggctcagtctgaagcagggccatctctgatacctggttatggcctcctggggacccatcagagacccaggctgaggctggtggtgtcaagagcaccagcttgcctagagggcacagacatgcagatgaaaccagtggaagcacagaggtccgcagtgtctgagctgaaattgctgctactagaaatattagcacagtaggagagctgagcttttgaatcaggtggtcttcagtatgaatctttgccttgtcacctagaagcaatatgaccctcgtcaagtcactttctgattttttgaagtgataatgacatgcagttgagagtccgggtatccgggcacagggcctgctgcgctggtagccgttactgcaggcaggtcctgatagggctggggaagtgctgcaagtggcagaactggggctggaatctgggcctgattcccaggccacactggggttgcgctggcactgaggggggctttgcagagagcacgggccctgcatgtgacctccctgggcttcaggttttcactcagggtctgtggaaggggctggcataaattctcaggaaattgggcttctgggttccaatttagccactctccagcttggtgaccttgaccctcccgcttttctgtaagctttggtttctttttttctttttttttttttttgagacagagttttgctgttgttgcccaggctggagtgccagtggcctgatcttggctcactgcaacctccacctcctaggttcaagtgattctcctacctcagcctcccaagtagctgggattacaggcacgcgccaccatgcccagctaatttttgtatatttactagagacggggtttcaccatgttggccaggatggtctcaatctcttgacctcatgatctgcctgccttggcttcccaaagtgctgggattacaggcatgagccaccgcgcccggcctagcttcggtttctttactgttacgtgaggctgaagagaacctccccagtctgttggaaaggtcactatgagcagttgatggggaaggatgttcagcacaagaagcagtgcaggtgggagagtccgggtactgatgtggcctcttggaccaccgccagtgctgccttctgttcccagaaagccagggcagacctccttcgtgctgcctctgccatacagagcaaggggcataagtgaatcctcctgtccactgagctcaggaaactcattctaagggaagagattggcagaaagaggggggccaggcgagttgggcctcccacatcagaatatcttgataaagagtcagaccccagagccaggcttccctggttcatatcccacctgtgtcactggcaccaagccagcctccttccctgcttcaatttcttcatctgtgtaccgggaatcatcatagtacctgcctgccaagctcttaataacatttgtggcacacagtatgagctcgaatgttcactgctgctattaccaggcaaaatttggaaatacagtgttgcttaaattgggtatctataggctgggtgcagtggctcacatctgtaatcccagcactttgggaggcaaaggtgggtagatcacttgaggtcaggagttcgagaccagcctgggcaacatagtgaaatctcgactctactaaaaatacaaaaattagctgggcgtggtggtacatgcttctaatcccagctactcgggaggttgaggcaggagaatcacttgacccaggaagcagaggtttgcagtgagcaaagatggcgccactgcactccagactgggcaatggagccagactctgtctcaaaaaaaaaaaaaaaaaaaaaaaattgggtgtcttacctggcaaagtgatttcatctcctgctcactcaagtagaagtagactgcactgcaaggagaaataaaaaatatttaagtcctcatagtcataaagaaatactgaacacatggcaagagcacctcacttttttttttttttttttgagatgaagtcttgctctgtcgcccaggctggagtgcagtggcgcgatcttagctcactgcagcccccacctcccaggttcaagcgattctcctgcctcagcctcccaagtagctgggattacaggcacgcgccaccacgcctggctaatttttgtatatttagtagagacagggtttcaccatgttagtcaggctggtctcaaactcctgacctcgtgatctgcccaccctggcatcccaaagtgctgggattacaggcatgagccaccgcacctggccaagagcgcatcactttgaaggcgcatccactgtgggcctgccctgggcacctacccttgtgtctggatagcctgggagaagggctctgtgattggccaagggtgacttaagctctgctgtggagaggatggggagacccgcctcccaggagtgagtcctggatgcggaagagggagcggcagggggagtcagggctggaaaagtcccagcctgctcagaaggcctggaacgctgggataagaggttggactttgtccttttggcagcagggggccacggaagggtgttgcatgctgaagggccgtggtcagcctgttttggggagactgtacgcttcactcctgccccctggagcttccaggactgcctcatatcctcccctccccccaaaaaaggtcaggaattgggctgggctggcctggctgtggtgaccctggtcttctcctgtctccagagagatcttggtagaggagagcaacgtgcagagggtggactcgccagtcacagtgagtacctgctgtccctgcagagccaggcctggtctttcaggcacatgaagtttcctcttcatcttgggggctctataagcccaaccctaagctcttttatctgtcctttccctcaccttcaacggagcactgctaaaagaagtgggggttgctgtgcacgttggctcacacctgtgatcccagcattttgggagggcaaggtgggcacatcacttgaggttaggagttcgagaccagcctggccaacatggtgaaaccgtttctactaaaaatacaaaaattagccacgcgtggtggcacgtgcctgtaatcccagctacttgggaggctgaggcaggagaatcgcttgaaccccagagttggagattgcagtgagctgagatcaggccactgcactccagcctgggtgacagagggagactccgtctcaaaaaaaaacaaaaaaaaacaaaaaaaacaggccgggcgcggcggctcacgcctgtaatcccagcactttgggaggccgaggcaggtggatcatgaggtcaggagatcgagaccatcctggctaacatggtgaaaccccatctctactaaaaatacaaaaaaattagccaggtgtggtggtggacacctgtagtcccagctactcgggaggctgaggcaggagaatgacgtgaacccaggaggcggagcttgcagtgagccgagatcgcgccaccgcactccaggctaggcgacagagtgagactccgtctaaaaaaaaaaaaaagaaaggaaagaaaagaaaggggttatgggaagggactttggatttgttagtggagattcttggccagggcagaaggactcctatttggcgagtgattctgctcacatatctccagggctctgtgttagtaacttgattctgggtactttgtggggagtagagagaggaaggggccgggacatctacctggaaggacttagttctagctcttgcctacagaatagttggtactcagcataggacagtgggtatggttccagaccagactgacttggggtgggagaggagaattttggtcctaggaagtagaagtgcagccaagagtgataaagctcactaaagcagcgggtgtttggagggtagtccctggcaactcccactgcttgagttccaaccccactcttcctgttccccaggtgtgcggcgacatccatggacaattctatgacctcaaagagctgttcagagtaagagtgtggccaacactgtgaaatgtaacggggggatgactggaagacccctgtaattgagggtgggagccttaatttggggcgtggagtgggggcaaggggccccaagttagatgggtggttgtggaagaagggcctccgctggacagaaacaggtagggggtaggggactgtttacgacagggcaaaactttctacttccccacaggtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccacccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaaggtaagccagcccagggctccatgggacagggagaggaggggggcttcaggcctcagccccgtcctctttccctgctctcccctgtagatcttctgcgtgcacgggggcctctccccctccatccagaccctggatcagattcggacaatcgaccgaaagcaagaggtgcctcatgatgggcccatgtgtgacctcctctggtctgacccagaaggtgagggcatgtgggcaggggcaggcagggacagccaggaggggttgggaaagagagggagcagggctggtcttcactgtcactcgtcctccacctgccaaatggctggaaccctggaggaggagcagggaggcctgcatggcaggtgctttgagcacacagtggcttggggcatggcccagagggctgtggaggacaaccaagtcatggctccctgaagtgaaggggccttagaacatgacagcagcttcttcagaggtcagaaccccagaatggtagccccctgagacccctcattttgtgggttttccactagtgtagagcagagctgagatttaaagtcaggtcttctgaggaccagccagagttcctgttgtcacaggcacacacgcacaggcagcctctgctccagcgcagacacacacacacatacacatagcctctgctccatcacagccacacacacgcacacgaggcctctgctccatcacagccacacacatacagacacacacatgcagacacacacatgcagccgctgctccacagtcactccggacctccctgtgacaacacagggtgcccttctgtctctgggagtgcccctttcactcttatgtgctgtttggacggggattgtatgatcactgtgattatgagggggccccaggcattgggcgttctttctcctctggagcttatctgcccctacatttgctgtcctggtccccgccatcccacagaccatattcaggccccatgctctggtcccacgggcctctggtggacttggggaggggccaggctgctcaccctcaaggggcagcgctggcagccagagaagcctgaggacatccctctccatccctccctttccgcatcagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccggtgagccggctgggccgggctgggatgggcgggcatctgagccgagctgctcctgaccctgctgccccgccttccagctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtttttgggtttgtgccagacttggttgggaatgcacagggttgctggcctgggacctggggtggacgtcagggccttgactgcctcagggccccgacctgccaagagggccaggctcaggccagtcagcttgcccagggcctccaggggccgctgcctgctggcttccccagccctagggagagggctctgttctcatgggcagccttatcttattaacagcatacacacacaggcacacacagaatcacaggattctgatttctccattttcctgaagaggagatgggcctagagggccagtggattttgtgctaggtcaggcagctggaaacacaggtctagatctgggcctgggtctcctagcaaagcctttgctcacccagccccgcccagggccaaacacaggagcccaatgtttcctgagcatggatggcttttgagttttattaacaaaaatactctggtcccagaacaacagactggtgtggcctgcaccagtgtgtgtgggggggtggggattgagcccctccagagcccatggggaggcctggtaagtggggatgctggtctgtggccccatttggccaggcagagccccttccattcacacggaggtgagagccgggaaggggaagccggccccagctggactcccagcagccttggttaggctttgaagccagaggggggtgggagtgaaatcaaggtgtgaagttgagggggtgggtgggcaggcccaaggcggccatttggtgtgggggatggggccggtggaggtgagggggctccagggctgggggaagggagcgggaggtttgtgatggaggcagaggggcccagcagtggttcagtacatgggtttggagcccacatccagatagcccccaggcgcggtgtatggtagagggaaggggcccccttggagaaagtgcggggcaaagggtaccgccggtggagccgctgggtacccggagccccctgacccgtgcggcagctccagaaatgcagccgagtagggggctgagcgcccggagtctggagcctccgggaagctggggctcctgacatggagagagggatgtcagagcagggcagagggacccgcagccccgcctggtcccctgtcccactcacctggtgggaaggtgactgggggccccatggaaagccgcagggtgcaggaggtaggcctcagcactggggccaccacacagaggtgccggggcagcggtggcttccccgggggctggggcctgttctggatctgattcacgaatgtctccacccagggtggagtcgcagggaccacctggtgtgtctggggagagggaagggagaggttgggctagggaggatccctgtctcaggcctggccccatcgccatcgggactacactcacctccgctcccataggcctctgtggctgctggctctgggccccgcagtttcctcttcacacgggcgtctcgctccctggggaacagtggtggtgatgatgatgatgatggtgatggccatggtgatggtaacagtacttacccggtgccaggcatttcaccctcccagggaccctgtcaggtaggggccatcattatacccattttatagatgaagaaactgaaggccagaaaattaaataactagaaagtggcagagctggaattttgtccctgctcaaatttgtccatgctttcctattgtgtttagtatcagtggaaactccttcccagtggcaaggccagggcacagtctcacctagctcatctttctgccccatctccactctcagcctctctctggaatcctcttctgtcccctcttcacgggctgaacctgtcctttttcttttcatttttaaaatttgagatggggtcttgctatgttgcccaggctggagtgcagtggcacagtcacaggtcacagctcactgcagcctccaactcctgggctcaagtgatctttccatctcagcctccgaaagtgctgggactacaggcatgagccaccaaacctatccttgcctcactgcaagcgcaagttcctcaaggaagtcctccctgacctccgagagcacacacccctccctcataacatccgtcacagttctgcttttgcatttgatggagtgactccttggttcatgtctgtctcttctgacaaactggaagctacttgagggcaggggccagctctgaggtgctgcacttggaacagttcccacggccttacggaacctttactgtccgacataacctggcttcccctcccctgcctgactcttagtcactccactgcagccacgccacaggcacagccccacctcagggcctttgcacgtgctgttcccactccctagtgtgctttgccagatgcccacctggctccctcccgtacttccttcagctctttctcaagtgtcttcttcccactgaggcctttccaggcctcttatctaatacctcaccccagtccttcctatcttttcctggtttatttctcttctcctttttcttttttttctttttttttttttttttgagacagagttttcttttctttctttttttttttttttttgagaggaagttttgctcgtgttgcctaggctggaatgcaatggcatgatctcgactcactgcaacctccacctcctgggttcaagagattctcctgcctcagcctcccaagtagttgggattacaggcgtttgccaccatgcctggctaatttttgtatttttagcagagacagggtttcaccatgttggcaggctggtctcgaactcctggcctcaggtgatctgcccgcctcagcctcccagagtgctgggattacatgcgtgagccaccacacctggtctctcttctctttagaatggcttcctaacagatgacattttatttatttctcttgtctgcttgtctactctccccactagaaatcagctgcatgagggccggggctttggtttgctttgtttgttttatctccagtgcctggaactgtccctggcacatagcaggtactatataagtatttgctgagtcagtgaatgaatgttttcacttaccactgcatttctgatgtccagcacggtgcctggcacacagtgagtgattaataaacatttgttgaatgcatgaacaaatgaatgaacaactcccacctcttacagtttctgccgttctcccggaagcctttggcaaagggattggctgcaatcttcagttgtgtgatctggggacacacatgcagggtcaaagcaactgcggtctgggcagggggccaccaccccctcaagcagggtcactcacctgtgggttctggtaggctgtcacggagatgaatgtggtctcggggaagcggaaggaggccatgcccccccagtgctggctgcagagctgggctgcccgaactaggtgtatgcggggttggtacttgtgcatggagtgcaggatcagctgggagggaggaaatgggagtgattccctgccctgcgcctcacccttggcctcccttccagcaccccccaaccctatcctggagtcccagcctgggcctcacgtggccgtgggggtccagcgtgctgttggtgagcttgacacgatggaaagacacaggctgccgcatccaatgtgcaccagtggcaggagagtcggggtgaatgtagacacggtcaggcaggcggggctctgccttgccgctgggctcccagcgccggccctgccagcggtagcgagccccatccaccggaatcacatccagaagaaacaagtagcgggcctcggggtccaggccagtgactgacactcggcaggcagggaacatgcgcctgtgcaagggaggggacaggagaggcctggagctacccactggccaggggtgggcccagcaccagtaacgggacataacaacgggctccccagagctgtcagagaaacatcaaaggaggtggaattagaacccagagggcaggctggaggctgtggctcacacctctaatccctatactttgggaggccaaggtgggaggatctcttgagtcaggaattcaagaccagcctgggcaacatagaaagaccccatctctacaaaaaaattaaaaaattagccaggcatggtggtgcacactgatagtcccagttactacagaggctgaggcgggagggtcacttgagcctgggaagtcaagactacagtgagccacaattgcaccactgcactccagcctgggcaacagggcaagacactgtctctgaaaaatgaaaaagggccaggcgcagtggctcatgcctgtaatctcagcactttaggaagccgaggtggaaggatcatgaggtcagaagtttgagaccagcctggccaatatggtgaaacaccgtctctactaaaactacaaaaattagccgggtgtggtggtgtgtgcctatagtcccagctactcgggaggctgaggcaggagaatcgcttgaatccaggaagcagaggttgcggtgagctgacgagatcgtgccactacactctagcctgggcaacagagcgagactccatctcaaaaaaaaaaaaaaaaaaaaaaagaagccagagggcggaatcttagagctggaaggttttcttgtctcattttacatttggggaaacaggacagacgggttaagtgatctgtcacacagcaggttaggaacagagccatgactcctacccctcaaagcctatttgcagaagcaggggtgactaactttcttgctaggagcttcctgtccccaccctcctctcctcccctgatctccagcaccagaatctgcagctcttagatgaatttgctttagaaaaaatataccctgcctgcagtagggccgaggactttccatgctagggcttgagttcctgccccagctaaagacctcatctaaggtcaaacactgaccgtgtccctgcctctagggtgaccctggacctagtcatatactgactcctattcgagttgcatactgatcccgaatcctggccagatttccctgatgctggtcaatgggctggcccttgaccccctgtccttgtctggatgctggtctaagccacacactaacctataacccagagggacttcctgaccctgccccagactgacccatgacccttgccatagattggtccctaaactcagccacagactccacagactggcccttaacccttgtcacagagtgactcctgattcctgccacagagtaacccttgccccaggccatagtcagattctaggcctaggcagagctctagcccctcgggaaccacccagtcctagccccctccccagggactctgcctttcccaagagacccccaccagaaacacggaccctggccagcccctcacctcccagctttggtgatgatcatttctgttcccacagagctgaactccttccatagctcccggttctccaggctcaggctgacccccgggagggaatggagggcctctggagctgatggggccggctcagtgcccatggcagggggcagaaggggcagaggtgggtgcgcggccagggtgcggggagcagcctccatcccggagaggaagcaatccagtttaggggtgtccagttctggaagccggggaagaatgaggagccagccgagggccacagcccccctattctcctacccaggagctggtcccaacgctcaccggggtagcggtagccctccgctagggcgggtgggaagctggagtcggccccaggttgggcgggccccaggcggtagccggcccccagggacgggtacaattctcgtggatggtacatgttgtagttccgtctggcctcaggtctcgctgcttagggcccccggtgctgcgagatgccccctttatagctcacagctcagccccttccagatccaggatcacagcccctcccctctttggggccctggagttgggctggggtggagacccctggggcctcgaaggggtccgagagggggtcggatacctgggtacggtcccctcctcccctccctccccaccccgggaggcttcattagcctcgaccccctgccccctcattacataattaactcctcggcttgattgatccccagggctcggacagggacgcagtttggcgcttccggccagctggtccccgttcccacggtggggagccccggctagggataagctggggggcggggcctggaacctggacggagccaagagtcccgggacacaccttggcgccccagaccttctggcaggtgaccgccctccgccccccttcacttggaggccgggccctggagggaagcagcgtgaacagagggaaagtgcaggctagagggacgcggcctgagctgatttcacagggcactcggggccgcgaggaggccgcagcccagtcccgagcaccgtagtcctccctggtccccatgctaaaaaaacctccatcccgagccaagcctccaaagttcgaaggcgctcacagtccgacagcttctgacgcctcgcgccagggtttcccgaaggtcccgcgctggggaaccctcggaactacacttcccggcaggctcagcgctgaggcgcgcccgaaggagccggacggaccacgcgggggccgctgggagttgcagtccgaccgcgagggggctgcgaggccggcggcgcggttgcctccctgggacgctgcccctaggcggcggccaaacgctgcagatgagcagacgcagatcagccgaggtcacggcgtaggcagccagagtgggctcaggacctccgccagcagtgaaaccgtcccggttcccggagacccagcttggacggctgtgcctaccccatgccccgccggggctcagaaccgcacaggtctataggggcggaaatctccgcttgagctcccccttcccggattacacgcgagcctgagctgtctccactccattgttttattatgtacaaacgctacagaacgagggggacagacacgcgtggggtaagaagggcctggtgggaggagttcacagagcagacggtgcactgggaccaggagagcagaacacaggccataactatagggcaggtggggcaggaacgggttaaaaacgagatccaagccagccagatcgcaggaggtgcgggggcgtcgtcccccttctgttctccccccaaggtcacagtgcatgcaataaaatatatatacaggagctagatccgtcctctgcaggggctctgagggtccagagctcccttcgggtggcgggaagccagtggcgctccctggcggccaggccgggctggagccacatgcgtcgggggagcgggggtcagtcccagccgttgtctttgatcatgtggttgagttcaatgatgtacttcccctctttgtacttctggctgctctcaaaggcctgttcctgaaaggaggggcgggaccgtcatccccggagcaacagtctcaccacaaggcactggggttgggaagtggacatgagtggccccattttacatatgaggaaactgtggcccagaggggcagggccgtatttctcacaaacacagagtagaatagaactccctgactcaaaggtacttttttaagtactaatgatggctccaacagagaagatagggaagtggctaaaagatttcacagttcagggtttgcaaactggtagcttcatggccattttggcctacaacatgtattatgtttggacagcagacagtttaataaaaataactttaaagtattaaaatataagtaggccttgctcactccagtttgcccagcctgcccccaactcccaaccctgccaatctatgctaccctttacacatctacagtatctgcttggccttgcaggcacttgaggtttttttgtttgtttggttttgagagggagtcttgctctgtcgcccaggctggaagtgcaacggcgcgatatcggctcactgcaacctccgcttcccgggttcaagtgattctgctgccttggccccgagtagctgggattacaggcgcccaccaccacgccgagctaatttttgtatttttagtagagatggggtttcaccatgttagtcaggctgttctcgaactcctgacctcaggtgatccacctgcctcagactcccaaaagtgctgggattacaggcgtgagccaccacacccagcctggcacttgagtttttgacctcttgtttaggccagctctttattaattattattatttttgaaacggagtctcgctctgtctccgctcactgcaaggctctgcctcctgggttcacgcaattctcctgcctcaacctcatgagtagctgggactagaggcgcccgccaccacacccagctgattttttttttttttttttgtatttttggtagagatggggtttcaccgtgttagccaggatggtctcaatctcctgaccttgtgatccacccgcctcggcctcccaaagtgctgggattacaggtgtgagccactgtgcctggccggccagctctttatttggtagaggtccagagtggccaagccacctgtccagagacacacagccaatctgtggcagggtcagcagcgagctcaggtcagggctggctggctggctctgcctgggacatccacctcacagaggcaccacagttccaagcgacgcctgaagaatcctgtcccttgcagtgtcccaagagcatcttcctgagcatctaatctgatccctgtaacaatcctgggtgctaggcagtggctttatcttccactgagagataaggaaatgagactcagggtagtgaaatcagaccctggacagcagcagtggcaatgaggactatggaaagggaggctggtgaacccaagctccatgttgttgcagagtctggggcaatttttctgatactctaaatgacaatataagctggtgaccaagggtttggagtgaaaaaaaaaaaccaaccaaccaactcagattctggtccctattctgttacttaccagttgggtgatcttgggcaagttacctaacatctctgggcctccctgtcttcttctgtagagataataatagcttctacctagaggatcactgcaatgattgaatgagataatagacgccaggcacacaacagtgcaaggcacataaacattccataaatggtgactctgattatatcctaactctctaatggggatccaagtgcctgggagagaagggatgggttaagagaaaagttctacaccccttgcaaggtgcaagataaagagaatgtggtcagggatgctgacttgtgtgagctcggcctatgcaatctgaaaggctatagggtgacagcttgtcaggaggaggtgttggaaggtcaggtcaaaggctagcctggggtcagaggtgggtgactcacatatttccagcccaaagtggtcttgcagttctcgcagtggatgtcggcgacagcatggaggccggtcagcagcacccgctcctcggctggcccgcagcccacgttcaccctgtggggacatggggtagtcccagggagggtcctgccatcacagggcccaccccctcaagcactgtgtctgtcctcagcatccaagaaatgatgctcacaatttcctgcctgcaccggggaactctgggagtctcagcaggatgccaggggtcacaggtcacaacagaggtcagggaaagcaagaagggaggccagatactcacactgagttgaagaggtaggcacgcccctgactgccctggaaggactaaagggtgagagggtgggaagagaggagggggtcagggctgccggtggggagctgccaggcagcccctataggttccagccccactgtggcctggttggttaccttggagatgaggtcgtcgtggttggccaggtgagcgcggcagtgggcacagctatacctccggtgacaatcatccaagtaggcctgaaacgtcttgggctttgaaatccgcaccatggcgggggccgggggcagtggccccacgcggggagcggcccacggggagcagagggagcccagtgcctgccggggagggagtaggtgggctgtcaggacctgggccacacacatgcgaggcactcccagagccgtggggactcgctctgtcacactgggctgctctctcctttccccagagccagcagcctctccggggaccagaggcgtctcggttttgactcagtgaggaggcctcaggttgcatccatggggaaactgaggctcggaggtgcccagggtgagtcacccgcctgcttccggcctcacccttgctgacctggcagctgaagctggaggaaggggctttggaggggctgggctgtcagttcccagtttcgggggagcatgggcgggtaggcactggttggtccttgcgacctcatctggagagcagtggggttcactggtggtttagggggttcatcggggagagggtcccccacctggaggaggtaggaggcctcgccgtgaaggttgagggtcacctaggaggggaggggctctcacctgcgggcgccaaggcctcctctacgctcaggggctcttacctgcaacgcggagccttacctggactccggggctcacctggggcgcgggggtgggggcgggcgccgggggagggggcagtcctcgcgggctgggcaggggcgcggggcgacacgcagccctgacggcgcgggcctcacctcgcctgggcgcgcggggcccggtccgccggggtgggctggcctgggagtggggggcgctcctggcgggcgccgtcccccccgggcccgggttcgcaggcgcctggacttgtttacaccgagcccagctgctgccgccgctgcggcgggagggggaggggacccgcctcctgtcccggcggccgccgtggccaatgggcgctccgcatgcaaatgagggggcgcgtcacacggcggccggcgcaggccccgaccgcccctcccccgccgcccgctcccgccggcccggaaatgcggctgcggcccgcgcgccccaggcctgctcgcattcctgcttgtggcccgcgcaggggcggggtcggaaggtctaggccgggcgcggagcgaggaagcgggtggcgctgggacgcatgctctgggggagatgagtataatgacccgcgtttgtccgccgcccgtgccccgctcaatccccgcatcaatcccgtgaggccgtttctcccgttggctccactgtaccgggggctgaggcccagggaggtctcgcggctccctaggttatccagctagtaagaggcgaagctggaattctcactgtgggcccattccatggcttttgccagagcgccagggacacactcagttcaccttctagcagggaagacccaaagatgcgcgcccctggcagccagggcgtcggaccaggcaattcctactgtccagcatcacctcctccaggcctctcggatgcctctgttgggacagctaagttcctcttcaaagactcaatttcctggtcataagctgtaaacagattctactcccgctttttcttctttgtcgcacgtctaccctatttgggaaagtttaaaccttagccaatcgggatcagctcagattgtgcggtccaaccccccagccaatggggaaaggacacagaaacaggaactgcgttagggttaaaaaccacttccctcctttgttggcgggtgctcttgggattgcaaccagcgcaagcagcacccttctgcagaagtaaagatgccttgctgggaagtcttctgtctcagtgctggtttttcttgactacactgagcacttgttttcaacaaatttgagggtcttctgggatcccattctcctttgggaggggtagcgattacttttcctcgtgagacacgtcccactgccttgttgcagtggcccaaggagcggaggatcgggtccacccaaagtgaggaataaatccggactttcagcaacgtgggcaggaaggagccttaaaattcccaggcaagtgggtaactctgtgcacagaccaaggtaagaaaagttgctactggggcgacaaagtatttccttggtggttggggtcacttggaggttgaaagtgcatggctgagacatgtcagtggacacgaatcgagtgtggagtccagacttggttccatggtcacctcataaggcttagggcggttttccagtcggggattataccgacccgctaatgctaagaggggcctgaaattcccacgagggaagcggccaaaaagtacgaagcgattattcatatgagtgcaagaaacctccaatgggaaaagggagaggttaagcccctaggaaatgggcaccaacctccagaatgggaaataccccaagtaagacagggagtacaaaaggccaagcagacaataaaattccccctgacagtcctctgggccttatgttagagtactggaggtataatgaaagaaccatgtaacacaaggaaagacagtgaatgataaaatattgctgttttatttggaccaaagaacctatcctcagaccctcagtcttttggccaaagtttggatcagacgaggattggatatgccaactcttaatccagtatgttaataaaaaaagtccagtctctcaagaggaaatagattatgctctgtgttggagacaggaacatgtccttccctttcccttaaaggatgacgtaaaagagaaaccaaactcagtaccctcctaggacaacccagttaagtcagattctacatctaaagatgccaatgtataggatcccctagaccatcttcccccgcctaccccacctcaggctaatcactcagtccctcccccacataaccctgccctgtgggccttgtggccccacatccccattgagcagccacccgaacatgtcctttcctcaggaaaactccagcacgagatggaacaatgccggagggatattcagaactttccttttccctcttcctcaaaggggtctgccccaaccccttttcccttaagtaccactgggaggagggggtattggtttcgtaaatgcccccttaactagttcagaggttagaaatctgaaaaaggaactcaaaccattatcagatgatccttttggagtcacagatcaaattgaacaatttttagggccgcaattgtatacttgggctgaattaatgtccatcttaggtattctcttctcaggggaggaaagaaccatgatccgcagggctgctatgatagtctgggaatgtgaacaccctcttggtcaaaacatccctgcagcagagcagaaattcccagcccaggaccctcagtggaataggaacaatgcagcccactgagaaaacatgaaagacctcagggatatgataattaaagggattcaggaattggtgcctcaaacccaaaatatttctcgagcatttaatgtacaccaagaaaaagatgaagggcccatggaatttttaaagacacttaaggagcaaataagaaaatattcaggcttagacatagaggacccacttggacaagggatgttaaagctctattttatcaccaacagtcggccggacattagaaagaaattacaaaagatagaaaattggcaagactgctccatagaggaacttttaattaagagaggctcaaaggccgggcatggtggctcaagcctgtaatcccagcactttgggaggccgaggtgggtggatcatgaggtcaggagatcgagaccatcctggctaacacggtgaaatcctgtttctactaaaaaaatacaaaaaattagccgggcgtggtggcgggcgcctgtagtgccagctgctcaggaggcttaggcaggaaaatggtgtgaacctggcaggtggagcttgcagtgagctgagatcacgccattgcactccagcctgagagacagagcaagactccgtctcaaaaaaaaaaaaaaaaaagaaagaaagtgattaactctgatttgggttccaccgtcagatttatttattgatttattgatttatttattaaaaaaaaattcccagggaagtggtcaggagaaaacgataccctattcccttagaagctagaatggctctaaaacctataattgagggcctcgtccatgacggaccccttgaaccctgtatgtccccttataacactccaatattgcctgtaagaaagtcagatgggtcataccggctagtagaagacctctgggctgttaatcaaacagctcaaactacccaccctgttgttcccaacccttacactattatcagcaaaatcccatatgatcaccagtggttcacaatgatagatttgaaagatgccagctgggcacggtggctcacacctgtaatcctagcactttgggaggctgaggcgggcagactgcccgaactcaggagtttgcaaccagcctgggcaacacggtgaaaccccgtctctactaaaatacacacacacacacacacacacacacacacacacacacacacgccaggcatggcagcatgtgcctataatcccagctactcaggaggctgaggcaggagagttgcttgaacccaggaggctgaggttgcagttagccgagatcgtgccactgcactccagcctggcaacagagccaggctctgtctcaaaaaataaataaaataaaaaataaaaaaagaaagatggcttttgggcttgccctttagcggaagacagccgggacatgtttgcttttgagtgggaggaccctcacttaggtcgaaaacagcagtaccagtggacagtcctaccccaggggtttacagactccccaaatctattcggtcaaattttagaacaagtcctagaaaacttttcccttccttcatccatatgcctactcgaataggcagatgacctgttcatttcaggaaatagcaaggaccacataaccacagtttcaattaacttcctgaatttcctaagggaacaagggttacgggtctcaaggagtaaaattcagtttgtagaacctgaggtaaaatatctaggacacctaatcagtaaaggcaaacggaaaatagtacctgaacgaattgaaggtgtcacatctctacctttgcctgaaacaaagcaggaacttagaaaattcttgggattagttggatactgtcgtctatggattgactcttatgcctgaaaaacaaaatctctacataaaaaactcacccaagaaggaccagacccccttctttggaccctatcagaagtccaacaagtagaagagttaaaacacctacttgtaactgcccccgttatagctttgccctccttagccattccaccttttcatcagtgtaaacaaggggttggctttaggggtactcacccaaagacacagaggccactggcagcccatagccttcctgtcaaaagttcttgacccagtaacccaccgatggcccgaatgtgcccagtctgtagcagcaactgctttgctaatggaacgaagcaggaaaataacctttgggggaagcctcattgtatgtacccttcatcacgttagaaccattcttaatcagaaggcaggaagatagctcactgactcaaggattttaaaatgtgaggctatcgggtgggtgtggtggctcacgcctgtaattccagcactttgggaggctgaggtgggcagatcacaaggtcaggagtttgagaccagagtgcccagcatggtgaaaccccctctctactaaaaatacaaaaaattagccaggcatggtggcgcacgcctgtaatcccagctacttgggaggctgacgcaggagaattgcttgaaccccggaggcggaggttgcactgagccgagatcagccactgcacttcagcctgggcaacagaacgagactccatcctccacccaccccccaaaaaaattgaggctatcttattagagagggatgatttaacattgaccactggtagttcgctcaactccgatgttttcctaacaggaaatccgaaccgggaggaacctgagcataaatgtttagatctgatcagttatcagactagagtcagactgcatctaagcaagaccctgttccaaactgggcattacctctttatagacggctcctctcgggtaattgaaggaaggaggcataacgggtgctctgtagttgacagggaaaccctcatggaggtagagtcagggagacggcccaataactggttcactcaaacatgtgaactctttgcattaaatcaggccttaaaatctctgcaaaatcaggaaggaactatttacactgactccaagtattttggagtagtccatacctttggaaagatctggactgaacgaggcctcattaatagtaagggccaggaccttgtctataaagaattgattatgcaagtactagaaaatcttcaactgccagaagaaatagtggtggtccacgtcccaggacaccagaaaaacccatcttttgaaaaccggggaaataacctcacagatcaagtagccaagcaagttgcctcttcctgagaggcacccattttccatctgaccccttgccttcccctccagtcgcaatccccatcttctccgacgcggaccaagaaaagttaaaaagaataggagctaaggaaagctcagagggaaggtgggtattaccagacgggagggaaatgctgtctaaacctcttatgagggaaatattatcacagctttatcaagaaactcactggggtccccaagctatgtgtgacacagtcctcaaagcctatgggtatataggaatctctaccctcgctagtcaggtggcggatagttgcctagtgtgcaaaaaaactaataaaacccgaaggaagcagcctttactttatcaagggaaccacccctataattgccaatccaaccagtgcaacccagtacttacctctattactacccctacctccaccgaccctaactccactctaggttgcttctatggcttaggagccgatgttactggaagggaccctataggcttctttgaaatatgttttgttcacccttctccacctcctaccgtctccccctccccaagcccaccaaatcaaaccattcctcacctcttacccaatgacaaaaccaaagtagctatagtagaagtcaaggacttaaagcaaaccctagccattgagaccgggtatcaagatgcaaatgcctggctggaatggattaaatattcttttcgcaccctgaataaaagcgattgttactcttgtgcagcgggcaggccggaaacccagattgtcccctttccactcagatgggccaaccaaccaggcatggactgtatggtagctctcttccagcacaccacagcctggggaaacaagacgtgcgccactctttcactacgtttcccaaagatcaggagccctacgggtcagctcccaaggaccatttgacttccacctctcaatgccagttacaccttgtgtctcccacaacaggacaaattgacgttccttggaaatctaatgggagtctaaaccttttcaagagctaaccaatcagtcagcccttgtctatccccgagcagatgtatggtggtattgtggactgttactgggtacgctgccaagcaattggagcagcacttttgctctaatccagttggccatccctttcaccttggcatttcatcaaccagacaggaagcaagtaacccaaagaaaaagagaagcccctcgtgggcctttgacccccatgtttacatagacagtagcagggtcccacgggagctaccaagtgaatttaaagcttggaatcaaatagccgctgggtttaagtctgttttgttctggtggtctgctataaataaaaatgtagactggataaattatatatactacagcgagcagcgattcgtcagttataccagggatgccatcaaaggaatagctgaacaattaggccccaccagccagatgacctgggaaaatagactagcccttgacatgatattggcaggaaaaggcagagtctgtgtcatgatctgagtccaatgttgtacttttatccctaataatacagccgccgacgggaccatcacaaaagctttacaaggccttaccaccctggcaaatgaattagccgaaaattctggactagataacccttttatgggtctcatggaaaagtggtttggaaaatggaaaggactcctggcttcaatctttacctctcttgcaattgtaacaagtgtacttatccttgtgggctgccgcatcataccttgtattcgtgggttaactcaaaggctcatagaaacagccctcactaaagccttcctctcttctctccctccatacttggacaagctcttgctcctggataatcaagaagaacaacgaagccaaatcctgttaaaattttttgcagaggaagaagtatcaaatagaagagaggaaattgttgggacagctaagctcttcaaagactcaacttcctggtcataaacttctccccgtttttcttctttttcgccagtctaccctgtttgggaaagtttaaaccttagccagtcgggatcagctcagattgtgcagtccatccccagtcaatggggaaaggacacagaaacaggaactgcgttagggttaaaaagcccttctctcctttgtttggggtgctcttgcgattacaagctgcgcaagtagcaccgttctgaagtaaagatgccttgctgggaaatctgtctcagtgctggtttttcttgactacactgagcacttgtttccaacacccctgtgctccaggctgggttaggtctgatctcagggaatgtctgtttcaacacgtgtctgcagttctttggcttgtgttgctcactgcagtgggcccagcctggtctagaggaggcgctcaggaagtatctgtgaaatgtgaatgtgtagttccttcagtgaatatggccctggggctgaagatggcagaagcattctgggagcttctggagaaggagacctgggaggagaaggttggaatggcgggggcagcagaggggctgggtgaactcagctgtcccacccaggcccatcctctgcagcccgagaaggaagctcacagggcaagacatggaagagatcaagttccctgcccggtgcctgggctgttgatggcctcaggaaaatggaaccattacctgttgctgtcaagtggctgggggccaggatgcctgggttggccgtgagaggacattgctgaggagagtggaggccaggctggggtggggtgtggcaggaggacaggaatgcagtggaaccagtgggtcaggctcctgagggccccaggctccagcctcagggctggcctgttccctcctaagctgccatcttcatatcttcaggacccacccctctactcctcaccctcagcacaacgatgtgatcgaaaggcaaatatttatttttcaggaagagaaacaggagacctcgaggcttctggacttaggaggtccgggcagctggtccatggttgtccaggtagtgccgcagggctgtgggataatccgttatgacgccagtggctcccacgctgaaggctgcttcaaaatccgactcttcattaaggcaccaaaagaccacctgagcagggagggagggggcctgtagattctgaacaattttacatctggagagtggggacccacctcctcctctatggagactccccagcagcagtaggctggagctgattgttaaattctcaggaattttgcaaagtggttattaaacccagccattattaaaaattaaatcatagcctgggtgcagtggctcacgcctgtaatatcaacactttgggacgccgaggcaggagttgaggccaggtgtttaagatcgagtgagacctcatctctacaaaaaactttgtaaaaattaattagcccggtgtggtggtatgcgcctgtgctcccagctacttggaagactgaggtgaaagaattgcttgagcccaggactctaaggctgcagtgagctatggttgcaccactgtactccagcctgggcgatacaacaagacctcgtctcaaaaaaaaaaaaaaaattatatatactgacaattaaattatttatttatttatttatttattttttgagatggagtcttggtttgtcacccgggctggagtacagtggcatgaactcggctcactgcaagctctgcctcccgggttcacaccattctcctgtctcagcctcctgagtagctgggactacagatgtccgccaccacgcccagctaatttttctgtttttagtagagatggggtttcaccatgttagccaggatggtctcgatctcctaacctcgtgatccacccgcctcggcctcccaaagtgctgggattacaggtgtgagccaccgcgcccggccctaaataaattattaaaacaacaagtggccaggcgtagtggctcacgcctgtaatcccagcactttgggaggccgaggcaggcagatcaactaaggtcaggagttcgagaccagcctggccaacatggtgaaatcccatctctactaaaaacagaaaaattagctgggcgtggtggcgggcgactgtaatcccagctactcagaaggctgaggcaggagaatcgcttgaacccaggaggtggaggttgcagtgagctgagatcacgccattgcactctagcctgggcaacagagcaagactctgtctcaaaaaacaaaacaaaacaaaaaacaaaacccaaaacaaacaaaaatccagtaataaatattcaaagcatatctcttgctaatcagtttcctattactgtgttcttgaagtgattaagtctgttgaggctgcaagatggaaatactacatgatggggtgccaccatgcatctcttcccattctgcatttagtggcttcatgtcggcagcctgaaactggccaagatgggagtatttaaaccaggaaaattaatcctcaaatcagggctttcatttgttcctctctgagagctagttgttgaccacttaacagcaccaccctcccccaaacccccattccactgccacctgccccagctcctgcagctctgccccttccctgcccgttgagtgggcactgaggtaggcggagatgggaattttttatttaaaaatacagatgagacgaggtctctctgtattgccaacactggagtgcagtggtgtaatcacagcccactgtagccttgacctcctgggctcaagtgatcctcccacctcagcctcctaactagctgggactacaggcatgcactaccatgcccagttaatattttatttatttatttatttatttttgagacagtcttgctctgtcgcccaggctggagtgcagtggcgtgatctcggctcactatagcctccagctcctgggttcaagtgattctcgtgcttgagcctcccaagtagagctgggattacaggcatgcgccaccatacccggataatgtttacatttttagtagagatggggtttcacaatgttggccaggctggtctcgaactcctgaccttagttgatccgctggccttggcctcccaaagtgctgggattgcaggcatgagccactgcaccctgcctctgcatttttcttttctttcccttttcctttcctttttcctgtttccctccctctcctccctctccctgtctctggctctcacgctctttcctctctctcttttgagacagtctggctatctctcccaggctggagtgtggagtgcagtggcgtgattctgattatagctcactgcaccctcgaaaccccgtgctcaggtgatcctcccatctcagcctcctgagtggctgggactacaggtgtaaaccactgcgcttggctaatttttaaattttttgtagagacgagggtctcagtatgttgcccaggctggtcttaaactcctgggctcaagtgatcctcccaccttggcctctcaaagggctgggattacaggtgggagccgtgcccagcctctgcctatggcatttcttccctgtacccttgatgggaagctcccacccctagtaccatagtgcctggaacattctcaaggatcgtttactaattaaatgatctggtggaagccaatgctcaggggagaggggggtgggctgggcctggtttctcccatctctcatctttccccagccccctctcatcagggatcatgatacatcattgttgtcatcataatggctaacatttatcaagcccttaataagtactagttacatatccatatgttggcaatgtcaggttaagaaaatatgtgcgtggccaggcgtggtggctcacacctgtaatcccagcactttgggaggctgaggcaggtggatcacttgaggccaggagttcgagaccagcctggccaacatggtgcaaccccgtctctactaaaaacacaaaaattagccaagcatggtggcaggcacctgtagtcccagctactggggaggctgaagcaggagaatcgcttgaacccgggaggtggaggttgcagtgagccgagattgcaccactgcactccagcctgggtgacagagtgagactcttgacacacacacacacacacacacacacacacagaagaagaaaattgtgtgtgttcgtgtgtgtgtgtgtgtgtatccagagagttaaatataccattttcccattttagggacgaagaaactgaggtgaggtcacctgcccgagtgatgcagctagttggcagcagagtgggaccggaaccctgctgccaggtctgtgtgcggtggaagtggtggtcacggcctcacctgcacccctcgctcctccaagtgtcggatcagactcttcctcatgatcagcctgggggtggggtggggacgtgggaggtgatgatgagaggggacctgggagaagggcagcagtaggtctctatggggacacgccacccagccatcttgcccacctcaccatttcgaaaccacagccaataactggttcaggcaagagcaggaaaatgggaaataggtcctgcagagagaaggaagtgggggttagctcctagggtctcccctgtcccagaggtggggtgggctggtagtgcccccgccaactagggtagcgctgccctcccaccccccagaatcccccagaataacctttgtagttgccccagtgaacaattcacccattgttcagagagcctactctgaccaccacgcttcaagggtgtggccctccagtcaccattcaccagataaggaatctgggccttagagaacgaaagggacttgccagacccaaagcagagtggtggtggggctgggccagggcctcgcttggttccaaagctggacatccaggctgcaggccctcctggttgggcctggccagcttcttatttatctatttatcttattattaatttaaattaatttttttttttttgagacagagtcttgctctgtcgcccaggctggagtgccgtggtgcgatcacagctcactgcaagctccgcctcctgggttcacaccattctcctgcctcagcctcttgagtagctgggactacaggtgcccgccaccacgcctgctaattttttgtatttttagtagagacagggtttcaccctgttagccaggatggtctcgatctcctgactttgtgatccgcccgccttggcctcccaaagtgctgggattacaggcgtgagccaccgtgcccggccattaaaaaatttttgtagagacatgtctcactatgttgcccaggctggtcttgaactcctggactcaagcaatcctcccgcttcagcctcccaaaagtgccaggataataagcacgagccagccaagtgtggtggctcacacctgtaatcgcagcactttgaaagtctgaggtgggaggagaccagcgtggccaacatggcgaaacgccgtctctactaaaaatacaaaaattagccgggcgtggtggcagaccctgtagtcccagccacttgggaggctgaggcaggagaattgcttgaacccaggaggcggaggtttcagtgagccaagatcgcactactgcactccagcctgggccacagagtgagactccttctcaaaaacaaaaaacaatggccgggcgcggtggttcacgcctgtaatcccaacactttgggaggccgaggcgggtggatcacctgaggtccggagttcaagaccaccctgaccaacatggagaaaccctgtgtctactaaaaatacaaaattagccaggatggtggtgcatgcctgtaatgccagctacttgggaggctgaagcaggagaatcgcttgaatctgggaggcggaggttgcggtgagccaagatggcaccattgcactccagcctgggcaaaaagagcaaaactccgtctcaaaaacaaacaaacaaacaaaaaacccacaaaaaacctcgtgagccactgtgcccattggccagcttcttgagaccagacagcacttagtgggacgacccctaattatcccactccaggggtgactttagagacccttgacagtgtcctagggcaggctctggagtcagacccagggaaaacctaagctctggatttccagctgtgtgtccttgggcaaattacagaacctctctgggcctcagattctctagggtaccatgggagtcatgattcttatacctcctgggggtgctgcaaggtaaaagtcaacccaaaatatgttaaaacactttataaatcttgtataaggccgggcgcagtgggtcacgcctgtaatcccagcactttgggaggccgaggcaggcggatcatgaggtcagattaccatcctggctaatacggtgaaaccccatctctactaaaaacacaaaaaaattagccgggtgtggtggcgggcgcctgtagtcccagctactcgggaggctgaagcaggagaatggcgtgaaccagggaggcagagcttgcagtgagccgagatcacgccactgcactgcagcctgggcaacaggggaagactcctcaaaaaacacaaaaaaaatccggtataaaaaggtggtacacaaatatcattgatctctttgtagcaaggtattgtgggggctgagtgggacttccttctggacaacagaggggagcagagagctctgggactaccacagagaagctgtcagaaagcaaagggagaccgggcccaggggctcaggtatgtaatcccagcactttgggagaccaaggtgggaggctcgcttgagctgaggagttcaagagcagcctggtcaacatagtgagaccttgtctctacaaataatttaacaattagccaggtgcagtgttgcacgcctatactcccagctacttaggaggctgaggcaggaggatctcctgagcccaggaggtcgaggcgcagtgagtcatgatctggccactgcattccagcccgagcaagactgtctcaaaaaaaaaaaaaaaattgtaaagcaaagggagggactaggcttaagtgccagcgaagtatccaaattcctgatcctttccccagctgttactttgttaacccctgccttcctgcagaacactgacttggccttttcctgctgagggtctgagacagccgtgctataattaatgaacgaatgtctccccagccagactgtaagctcaccaaggacctctccccaccctcactggtctcatttacacattataactgcacctgggacagagtagacattcaataaaatatgctagatggcctgagatggataaattacctctctatcctaaaactccacatatgcacagaatttcagggtgttcacagttcccttagtattcatgaatgctgggtaagaaccactgtccttaaaagaccttgggggttatctctgaggggagctggggagctgggaagatctgggctccttctccacggagaccctaagcagtggggagtttttctgaggtccgccccccactggtacctgttgatgatgttgggcaggaagcagaagaagaacttctcagggattgggatgaagggcagcagccccaggtagtaggaaagcagcacccagaatcctcggcttattgtgaaggacaggggcatctcggggttctggggaggcaaggagaggcatgagaatctgtctgctctggggaagcagagaggaggcatgagctgcaggggagccgtggtgggcattccagaggccctactacctgcaggatccaagtcacatcttggggctgggtgtggtggctcacgcctgtaacctcagcagtttgggaggctgaggcaggtggatcacctgagatcaggagttcaagaccagcctggctaacatggtaaaaccccatctctactaaaaatacaaaaattagctgggcgtggtggcgtgcacctgtaatcccagctactcgggaggctgaagcatgagaatcgcttgaacccaggaggcagaggttgcagtgagccgaggtcgcaccaccgcactccagcctgggcgacagagagagactgtgtttcaaaaaagaaaaaaaacaaaagtcacatcttggctctgtgttcgaggcctgagttcacacccttttcattgccaccgccacgccactgggaactctcccagacccctctagctcgggtccccatgctgggtgggctccagctctggggaggaggggcccctggaggaggaagaggacgggggaggggtggggggactcacggcagccttgcatttcttcatgaccgagctcttctccgaggcccagatggtgatttcattacggtcatagcgtctcaccaagcctgctatctgggaggaggagaaggaggtgaagggagagccaggcctctctcacgcccccggtggccgccctagccctgcctgcagcaccacctcacggatgagctcttcgttcttccctttgatctctacgctcatgggtgtccttggaaacctctggaacaggtcctccagacgaaccatgcgccggtctgacccgtgagcaaagtggcctgggggtggtgtgggaaaaggggtcagagggaagccaaggcggaggtccaaggaaggcaggcatggcccaggcagggctcgaagcccttgctctcacctggagagaagtaaacctccagcttctccttgtagaggggcaggtcctggggaggacaggaaggatgtcactagaggcccgcattgggcatggtgactctcagggtgggggttggggtgtcagggcagggcccacctcgaagtccaggctgcccacatccctgtttaggcccgactggcggcacaggttctcatcatgtgacaccaccaccactctgtcccgtgtcagctgacagtcgagctccaggaggtccgagcgctgggccatggagctgtgggggtgaaggtcagcggggggcaggggcaggggactgggatgaggggcatggtggctgggaggtggccgggaatgtgagagcggagttcgtggcgggatgtgcaggccacctccagggggcgccagtcacccagctaggaagtgaatggcgtcccttgctgtgatgcagtccacgacctgcacaccctcacatggcagcctgggcaggggcagatacactcacttctccatggcctccatggtgttctccagcagctctccagatcctgtggggggcactggagtgggcctctggggcttggggtctaggggcctggcccaacctcatcacccacattccctctctgggctccatcctccctctggcctcacctccccagccagcccaggctgcgccagcatcttcttcctcgtccacaccctgccctgccacttcgctctccttctctcttggtccctgccccgtttctagcatgcccccttggacctacccctctgtgctgtccactttggcacctgttctcacccctacccggctcacctcctcggtgggcccccaggcggatgcggaaggtgggagccctgggcgtgtgcagcagatgaggccggcgcaggaagaagatggagagcatggcatagctgcccagggcagggagggcatagtacagcaaaaggctcatgaccgtactcccacagaagctcctgcagccacacgctcagccgtccgcgggactgtgctgcctgcctagccagtgtgggccggctctactactggccactgccacgcccctgggacctgctgagcctgccgctgggctggcttggagccaggctgcagggttcggctgaagctggggtagtgtcaggaggtgaggcaagtagccctggctctcatatccccaggcccttcccagcccccagcagccccgtcctgggctacatgaggggagtaaaaaccacccaggactgtcaggacctctccctctcactggtacttgtagccagcgcatccaacatgcctaccccttgccatttcagaggatccaggggtgtgtagggtgctcctgagtcaccccgaatcacccccagccagttagacaggaagccattagcgagaggacaggacagtgactaaggggaaaactgacccccttctttctaggagtctggagctctccagagccccgtccccagccctgggcagctgggagtgaagggcaccaggcccctgaaagcccaagtcaagtctgtcctcagagccgcacggggcagggcgggggcgtcgcgaacacagacagagccagggtcagccatagacacatctctatatttatatattagacgggtcagggaggtggcaggggcgccgggctctccacgccccccagctccacttctgctcaccacacacagaagcagcgagggcacgcgaagtgacagctttgacagggaggggattcggcccggcctggctcctcagggatgctagcccttgagactaaggaatgttccttcagggaaactagggtggggtttgaatgagatgaggggggcaggcatggccctgagtccctactcagcgccccccaccctccacctctgcccttcagcaggttggggcagccagaacccttccattccagaactgccagagactgggacgctggggaaggtaagggcgcagcagcagcagcgggagattgaactggggccacctgaggtcccgaggccccgtggggagggcgggtggggaggagaaggccttggcctgcctgaagctggaggcctcagcaaaggagagaggtggccaggcccatgctccaccccggcctgggctgccaaggtccgggctgggcacagtgtccattttctaacagtctggcgggagaggggcaggcaggaggcaggtcctaaagagagaagcaggcagaagaggagtcgttagcaccccccgggcagacccactggagccctgacctcaacatctctcatttcaccctcacagctggataggctgggtctcagtttccttatctgtaaatggagataataatagtacctagcttgaggtactgctgtaagattaaaggaattaatacatgtaaacctcttagaacaatgcttagggctttatgctttcattattagaactgtctcggccgggcacagtggctcacgcctataatcccagcactttgagaagctgaggtggtggatcgcttgagcccaggagtttgagactggcctgggcaacatagcaagaccccagctccacaaaaaaaaaaaaaaaaaattagccggttgcaatggctcgtccagctagctgggaggatcccttgcacccaggagttttgaggctgcagtgagctatgattgcaccactgcattccagcctgggtgacagagcgagacactgtctcaaaaaaacaaaaccaaaaaaaaagataaatagattgactccggaaactgaggcgccgagaggtgaggtgccttgcccaatatcacacagcacttactaagtggcacagctggagtttgagcccaggtgcgcatgccttctttctatcaggccacacctggctgaagacaggaagagaccggaggaggcaaggaggcagcgtgggtgggggcaggccagtggggtccccacagctatgtgaactgctgatctggcagcaggtgtgaggaggcctggcaatctgggtcaggctgggcgctgctgggcccctcccaaagcaatcatggccccacctgcttctgccacacccagagctgaagcttggctcaggtcctcacctgggtgacagaggccctcagtgacctcttgcctctttgccagttctgttcctagaaggagattagaatggcttgtggggctggaggatgcaaggtgttgacaggcagagacatttggggctggaggactcggtgggccaccagtctgggcagccttgggcatttttttttttttttttgagatggagtcttgctctgtagtccaggctggagtgcagtggtgcgatctcggctcactgcaacctctgcctcctgggttcaagcaattctcctgcctcagcctcctgagtagctgggattataggcatgtgccaccacacccagctcatttttgtattctttacagtagagaccgggtttcaccatgttggccaggctggtctcaactcttgaccttgtgatccacccacctcggcctcccaaagtgctgggattacaggcatgagccactgtgcccagcccttttttttttttttttgagagagtctcactgttgcccaggctggagtacagtggtgcaacctccgcctcccaggttcaagcagtcctcccaccacagcctcctgagtagctgggactagaagcgcatgcctacgtgcccggctaatttttgtatttttagtagagacagggtttcaccacgttggccaggcaggctggtctcggactcctgacctcaggtgatccacttgcctcagcctcccaaagtgctgggattaccagagtgacccactgtgcccggctaatttttgtatttttagtatagatgggatttcaccatgcaggccaggctggtctcaaactcctgaccctcaggtgatccactcctctcagtctcagtctcccaaagtgctgggattccaggcatgagccaccacacccagccccctgggcacttctgttgtcaccagacacattgaccatgggtgtggggtaagcttgctgctgtatggaggcatgtacagatagatatagatatagatatacagatatagatatttagtatcagggtgtccatgtgtgggccatggagacactcaccaggccccagggtgcagagatgtctgtctgggctagggggcctccagcactccgggctggaagcgtgctgtctcctggaagatgagctccttcagccgctccttaggtaggtcatccagctccatggcgaaggtgaagggctcctcggccactggctggggtggtagagacagcaaggctcaggcctggcatgggggatgcctacgtgcccccctgctcccctgcccccagccccactgctgctggggactggcccacctcatccgtcgggtcatagtactgctccaggtaggggtgagccagcgcttcctccactgtgatccgtttattggggttaaaggttaacatccggtccagcaggtcaagggctatggaagggcaggagtcaggggtcacagggaagactggaggagctccgagaagcattgctttgcctgtctcctccagcggctgctgggctcacacaccctccacgacacccaaggtttatcccacacccaccctcatgtctctcgaacctttggagtctgacttggggaaaagcttggcccaagccaccttggtcttggagggcagagactgtaggtagtttcgggccttcatgttgatgatacaattcaggtcctcctgggatggggagcccaggatgcctgtggataaggaggtgacttggtaaatgatcacctctttctttctgggaacagaataggcaacaaggcaagaacaagaccccccagcccagcaacccatgccaatccctcagtcacctcctagtcattagcatggtggtgcagagcaagggggctgggttcaggcagaccgaggctcaaatcctaggtctggtgcctcctcaggtgtgggacttagccttgcttttcccatctatccaatggggataatatctatacctcattgagataccatgagatgctggaggcaccccacacgtggtggtatccctgacttggactctcgagaaatctcacctcggaaaagctaatcatccccaactcagccagccgggcctccctcacccagaatgtggttgagctgatccaggtagtgcttgccagggaagatgggccggttagagagcatctcagccagaatgcagcccacagaccagatgtcgatggacttggtatagccctgggggagaggaggaagtggtgagctcctgggccagcctcaacagggtcctgttgtctgcgccaggccaccacctccaagttagatccaacaccaggcagaaggcagaggcctggagggctcaatgctcagcttccttgcagagcccaaggcccagagggtagaattcctgtgtcatgggggtcagtgtctggctcagaggtagctccagggcttcctgggaactggtccgttcctttcaggagtgggcagcccctcctaccttggagttcagcatgatctctggggcccggtaccagcgcgtagccacatactccgtcaggaagccggtgtggtcatgctcaggatcggcaatccgggccaggccgaaatcacaaatctggaatcagacctagctgctaagctcggcgctcaaggcctctgcagcctaagcagtcacgcccccttgtctttgcctccactgttccctttgcttgcaatgttctcctgcccaaggcttcttctactggtcactggaagccccagaccctgggggaggaggggacaggtgcccaaccctctgaccttaaggtcgcaggtggtgttgatgagcaggttggagggctttagatctcggtggagcacgttggcggagtggatgtacttgaggccccgcaggatctggtagaggaagtagcagatatggtcattgctcagctgctggcttttcagcaacttgtacaggtcagtctccatcaggtcctgcacaatgtagctgaggatggttccgcagacccccccaggcagggggcagtgggaggcacttggttaaggaaaacaggctctgaaggcgaggctgcacacctcctccagccagggcccctgggactcaatagatctgccaacctgcaccaccagctggggaagctgctgccattacccagcggcagggctctgagcctctgttgcatcacagttgctgatcctgagcaaggggcttcatttctgaggcctcagtttccctaccggggaaacggggataataataaactgtgggaggcaggagaacttcacagttaagagcagcaacttgggccaggagtggtggctcacacctgtaatcccagcactttgggaggctgaggcgggaggactgcttgaggccaggagtttgagaccaccagcctgggcaacatggcaaaaccctgtctctactaaaaatagcaaaattaactgggcacggcggcatgtgcctgtaatcccagctactcaggaggctgcagcacgagaatcacttgaacccaggaggcagatgttgcagtgagccaagattgtgtcactgcactgcagcccggatgacagagtgagactctgtctcaaaaataaataaattaaaaaaaaaaaaaaacctacaaaaagagcagcaactctggagttaacccatggatgtctgaaatctcctctctactactcactggctttaggatctcaacctgtctgtgcctcaactttctcatctggtatgtaggggaaataatgtttttttgtttgtttgtttgttttctttttgtggagatgggctcttgctctgttgcccaggcaggtcttgaactcatgggttcaagtgttccttccacctcggcctcccaaagtgctggaaattacaggtgcaagccatgaaataatggttcttttgagggtggttgtgaagactagatgagatggcgcatgtaaagctgtcagcccagtgcttggcaagttgtgagtgctaggcaaacatgaactattattactaatatgaatgcctgagtcacatggctgttgagggagttaaatgagataatgtatgaacaccatctggcatgcaataaatgtttgcttaaaaataaatgcctgccttatgggaatggtttgtgcaagaaaaatgaggagacactcccaacagcacactcccactcaaaggagagtgcttggccatacctcagaagatggaggagtaaaatgtctttttctatttgaagatacaaaaaagcttatgcgtaaataaataaataaatccacaaatgctgtttggcttgtctctagaaaaataagtcagggctgtcttttagaatctgccttgagaccaggcatggtggctcatgcctgtaatcccagctcttcaggaggccaaggtgggttgatgacctgaggtcaggagtttgacgccagcctggtgaacagggcgaaaccccgcatctactgaaaatacaaaaattagccgggcgtggtggcaggcgcctgtagtcccagctacttggaaggctgaggcaggagaatagcttgaacctgggaggtggaggttgccgtgagctgagattgagccactgcactctagcctgggcaacagagggagactccatctaaaaacaaacaaacaaaaaacaaagaaaacaagaatcagccttgaaagggtcttcagagaatatgtggaccagccctgctgttttagggctggggaggcccagcgagacgcagtgacttgcttcagatcacacagcgagctgggggtgagcacggagatttcctgtccacagtttgtggtgggggttgcagacacctcagtacaaatccccactcttgggtggagggctgggactgagagtgggtgggtggggcagggaagaagtgacaggtgtcataagttgctaaggagagccagacaggaagtggacagcaaactaggaaagcagtattgggggaggacagccaaggctaggctgtccctccctgggcaaggtgcaagtccacaggtgattagggtgtggctctgagtgagaagtcctaagaagaaggacaagttcccatctgggggaggagaggaggagacagcaacagaaacacttgattttaggttttctgagccttagcttcctcatctttttttttttttttttttttgacagggtcacgctctgtcccccaggctagagtgcagtagcacaatcatagctcactgcagcctcgaactcctaagctcaagccatcctcctgcctcagcctcccaagtagctgggactatagtcgtgtaccaccaaacctggataatttttaaattttttgtagaggtggggtctcactatgctgcccaggctggtcttgaactcctggcctccagtgatcctctggtcttagcctcccaaagtgttgggactacagatgtgagccattgcactccacccctcatctttgaaatgaagctgaaaagcccatctcatagggtagttgggaggtgtaatagaaaaaaaaaagcattgggcatgtatagtacctgacacacagcaggccctcaagaaaggcagttttttgtttttgtttagttttgagacagagtctcgctctgtcacccaggctggagtgcagtggcacgatcttggctcactgcaacctccagctcctgggttcaagcgattctcctacctctgcctcccaagtagctgggattacaggcttgcaccaccatgccccgctaatttttttgtatttttagtagagatggggtttaaccatgttggccaggctggtctccaactactgacctcaggtaatctcccacctcagcctcccaaagtgctgggattacaggcgtgagccaccacgcccagctgacagttttctttctccctgtctcccttccggtctgggcaaggaggaaagagaggaaagaatcatccattccttagcaagaagtgactgtgggcagaggccaggtcatgtctcagaactgccgacgtcagaagacaccactcccatagagaccatcctgcctagcccttccccctggggcacagagcagagaacccacttgctcgaggccatactgcctgggccgctgcaggcctgggttcatcagaggtctccaagtcctgttacactgtggcttcccctctgcaggaaagtttattttactgggtttgttttggagggtggtgggtaagatggaaacagaaaccaagcaacgggtccccagcccagctgcgaggccgtgcctgaccagccgactggccaaggtgaaggatacacatctctcatggcttccagggtggacgcccgcagaatgtctcggatgccgatgacattctcatggcggaagcgcagcaggatctggatctcccggagcgtgcgctggcagtaggtctgatgttcgaaggggctgatcttcttgatggccacgcgagtcttgcgcacgtggtcataggccgagctgaggggaccggagagaggctgctgctgtggccttacaaagggggagtccgggcctggtggccccacccaggccttggcagggaggggagagagcaggagctggctctggtcaaatcataaacaatgctggttccttcctgctgtggaggcctgggatctccagagagaaagctggggaccagccaggcggcccttcggtgactttacaaacagaggaagagactgaccgctcactgacttcccctctcctcaatccccttccattctactggccctgaacccttcgcccccattcccaggaaaggctccttaacccaagacaggtccgggggtgcagatgctggggacacaccatggggcaaatactgggaaggtggcagccaggggaggggcaggagagaatggacagggcaggggagggtcccagggtgagggatccgggcagcggggctgtcccagagggatagaggcccagagcacacggtggggccgggggcactcacagacccctcccaaaacatgcaggtggcactcctggccgcctcatctctctctgggcccctggggtggtggggccaaagccctgccccaccctgatctcggctcttctcccccaggctccctggcactgcctcacagggggaatccaagacaccctttcccccaaaacgggccctccactgcctcttcactaaggatgtcgcctccccgagagtactcatcctctgggcctcgccccgtgtcactagggtccccgcgggcccccacatgcactcggatgcccctcccatcattacagaagggtggactcaaagcctccaagcctgctcccctgaggacgtaggcagcgccccctcccccagaaagcactcaggggccccctccctgggacgctcccgatcatcccgagtctcctgcctcctcgggacgctccgcgtctccacgtcccggaaagcgctcggcgcctcctcctcctctcccgcgaagccccctcccctgagggcaccccctcccccggaacgccccctcacctgaccatgccgtacgcgccctcgccgatgtactgcaactgcgtgtagcgcgggcccacgtcgaacggctgccccttcaccatctccacctcccccgggacccccgggccgaccccctcggttctacggggctccccgcccccgcccccctgagccgccgccgccgccatctccactcctcccctcccaccgccctcctccccacggcggccccgcccgaggccccgccccttcccgcctgcctgtcacccgcagggccgcgcgcgccaggccccgcccttgccccggccccgcgtgggcctggagctgtcacgtgacccgccccgcgcgcgcccgcccttcttgccccaggttcgggggccatgggtccctgcgggctccgcggcctccaggtcaccgggaggttcggcagcgccgcctcggagactgtcctcaccctcccctcgatggcgaagcggccagggcgtgacctaccagagccacccagccaatgtatgcggcagcccaccagaacctgggcccgggatcaccctaggttaaaaataatgttctaataaatggatcaaattttacagatggagaatctgagagttaggtttactaacttgggtaaggtcactagtagtgacagctgagactcaaaatggtgtcttctgacacagagactctttctaattccatgcctctcagagtcctagactgtttttattttattatagagacagggtctctctctgtcgtccaggctggagtgtagtggtgcaataattgctcactgcagcctcaacctccctggggtcaagtgatcctcccacctcagcctcccaaagagctgggactacgagtgcgcgccaccacgccctgctaattaaaaaaaaaaattggggggctgggcacggtggctcacgcctgtaatcccagcactttgggaggccgaggtgggcagatcacctgagtttgagaccagcctgaccaacatggtgaaaccccgtctctactaaaaatacaaaaattagctgggcatggtggcacgtgcctgtaatccaagctacttgggagactgaggcaggagaatcgcttgaacccgagaggaggaggttgcagtgagctgagattgcaccacttcactccagcctgggcgacagagcaacactccgtctcaaaaacaaaaaacaaaaagaagaagagaaaaagtagggttgcagaaggtagggactgaagaaaggcatgaaggagaaggatcggggtgagctgaggcataaaggcagaagcataacttgtccagcatggctgcagtaaaaaaatgatgaggtttcagcctggagaggtaggttggggccagattaggaaggctctggattctggcaaggagtttggatgttactcagtaagcagtaaaaaccctagagggacttttgccagatcattttgcaactgcgggagaatatagtgactcagagaaaacactatggagttcagcatggagccaggtttgctgagtgggagtgagtttcccagcataggaaaggctggtgtatcagagctgcaagctgccacctcctgctgctggaagctcagttagagtgtgactgagattcccctctagtgactgaggttggcatttccttggaggactggactgggatttgttctggttcatagacgcatattcaactaatgtagacttaccatctcttctgtgccaggcacttttggtttttttttgtttgtttgtttgtttgtttttttgagacggagtcttgctctatcacccaggcaggagtgcaagctcactgcaacccctacctcctgggttcaagtcattctcccacctcagcctcccaagtagctaggattacaggcgccagccaccacgcccggctaatttttgtatttttagtagagacgaggtttcaccatgttggccaggctggtctcaaactcttgacctcaggtgatccacccacattggcctcccagagtgctgagattacggcacctggcttgccaggcacttttatgtacactacctcctgtaatcctcacagcagccatatgaagtagatactattaacatttaactggaaaatgatgctggctggtcgtggtggctcacctctgtgattccagcactttgggaggctgaggcaggctgattgcttgaccccagcagctggagaccagcctgggcaacatagtgagatcccatctctaccaaaaatacaaaaatgagctgggtgtggtggcatgcgtccgtaatcccagctacttgggaggctgaggcaggaggatcagttgagcccaggatgttgaggttgcagtgagctctgatggtgccactgcactccagcctgggtgacagagtgagagaccctgcccccacccccacccccccaaaaaaagggacagagggaaaacgatgtggaagcttacgctctgtcacccaggctggagtgcagtggcgcgatctcagctcactgcaagctccgcctcccaggttcacgccattctcctgcctcagcctcctgagtagctgggactgcagacacccgccaccatgcctggctaattttttgtatttttagtagagacggggtttcaccgtgttagccaggatggtctccatctcctgacctcatgatccacctgcctcggcctcccaaagtgctaggagtacaggcgtgagccactgtgcccggcagaattatttttctagcacagggtcttgctctgttgcccaggctggagtggagtgtagtggcaagatcataggtcactgcaggctcgaactcttaggctcaacagatcctgccaccatgcctagcacacacaaccacgcctagctaattttttttttttgtttttgaaacggagtcttgctctgttgcccaggctggagtgcaatggtgcaatctcagttcactgcaacctctgcctcccgggtctcctgcctcagcctcctgagtaggtggaactacatgcgtgtgccaccatgcctggctaattttttgtatttttattagagagggggtttcaccgtgttagccaggatggtctctatctcccgacctcgtgatccgcccgtgtcggcctcccaaagtgctgagattacaggtgtgagccactgcgcccagcatttttttttttttttttgagatggagtctccctctgtgcccaggctggaatgcaatggcacaatctcggctcaccttgacctctacttcccaggtcaagcgattctcctgcctcagccttacaagtagctgggattaccggcacacgtcaccacgcctggctaatttttatatatttagtaaagatggggtttcaccatgttggccacgcaggtttcaaactcctgacctcaagtgatctgcccactttggcctcccaaagtgctgggattacaggtgtgagccaccgtgcctggcttggctaatttttagaatgtttgtagagaagggttctagctaatgttgcccagtctggtctcaaatttctaggctcaagtgatcctctcacctcggcctttcggagtgctaggattacagtcatgagccacttcggctggctccagattaaatcttaaaccagttattagctttttgtgattttcaaggtctggcacttctttttttctttctttctttctttttttttttttttgaggcagtgtcatgctgtgtcgcccaggctggactgcagtggtgcggtcatggctcactgcaacctctgcctctcaggctcaaatgatcctctcacctcaaccttctgagtagctgggaccacaagcatgtgtcaccatgcccagctaattttagtatttttggtagagatggggtttcaccgtgttgcccaggctggtctcaaatgatccgcccaccttggcctcccaaagtgctgggattacaggcatgagccaccatgcctggcctgaaatagttatttattcttcttattattagtagtagtattctggtctttcatgaccgtagacttttgaagattataggtcagttattttgtagaatgtccctcagtttgggtttgtctgatatttccttgtgattctcatgtcactttgcctttactattgtattgtatcgagacgaggttcaccatgttacccaggctagtcttgaactcctggtctcaagagatctgcccaccttggcctcccatcatgctgggattacaggtacaggtgtgagccactgcgcctggcctttcttttcatttcatttctttccttttttttgagacagggtctcgctctgttgcccaggctagagtgcagtggcatgatcacagctcactgcagtctcaacctcccaggctcaaatgatctcccttcctcagcctcccaagtagctggcactacaggtacacaataccacatctggctaattctttttgtatttttattaggatgggtttcaccatgttggccaggctggtctcaaactcctgacctcaagtgatccacctgccttggcctcccaaagtgctaggattacaggtgacagccactgcgcctggcctaattttttaaattttttgtagacacgacagtctggctatactgcccaggctggttcttttttttccccctgagtcagagtcttgccctgtcacccaggctggagagcagtggctcgatctcaactcactgcaacctccacctcctgggttcaagcaattctcctgcctcagcctctcgagtagctgggattacaggtgcccgccaccacgcctggctaatttttgtatttttagtagagatggggtttcaccatgttggccaggctggtcttgaactcctgacctcgtgatctgcccgcctcggcctcccaaagtgctgggattacaggcatgagccactgcgcccggccccaggctggtcttaactaggttcctttctgtctgtctccttcctcctcagatatgcctaaaacatggccctgatgaggttgtagtaggcaggaatctttcagtaacaagtcttcaaagacccaactcaaaaggactcaagcaagaaaggaggtgcattggcttactgactgtgaagacacagttggctccactgactcaaacagtatcattaggactttgatccctcccttagctcaactttcttctgagttggttccattcttagccaccccctcctctcagagtagccagatggaagctagtacttgcagattcgtgtctggttttttcagtaactccagcaagggaaagctcttctctctctgtctctctttctccctgtctctgtctcttgtaatgcaaggcctagatttgactcttattggttactagtttttttgagacagagtctccctctgtcacccaggctggagtgcaatggtgcgatcttggttcactgcaacctccaccttctgggttcgagagattttcctgtttcagcctcccgagtagctgggattacaggcgcccgccaccacgcccggctaatttttgtatttttagtagagacggggtttggccatgtgggccatgctggtctcaaattcctggcctcaagcgatccactcacctcagcctctgaaagtgctttgataacaggcatgagccaccgtgcctggccagttactagttttgtttgaagcctgtgcaaatccttcaacctgaatcagtgtggaattgggggtttagttatctctactggcatgacataaagtaggctagggaagggatggttttcccaaggaaaattcgggcaccatccccagaaagtgctgagcagacagttacagcagtgtctattataatatatatatttttaattcctccccccacctttttttttttgaggcaaggtctcgctctgtcccccaggctggagtgcagtggcaccatcatggctcactgtagactcgaccacccaggctcaggcagttctctagcttcagcctcccaagtagctagaactacaggcacacaacaccatgtccagctaatttttgtatgtatatatatatatatatatattttttttttttgtagagatggggttttggcatgttgcccaggctggtctcaagctcctgggcttgagaccagtcctccccaccagcctcccaaagtgctgggattacaggtgtgagccactgctcctggcctaattcctctcattaactaccaaatgaagtccaccacccctggctaattttaaaaaattatttaggagataggggtctctccatgttgctcaggctggtctcgaactcctggcctcaagcaatcctcttgtttcaccctcccaagtagctgggattatagatgcaagccaccatgttcagtttagattgtacaatttcttttctttttttcttttcttttttttttttgtttgagatggagttttgttcttgttgcacaggctggagtgcaatggcacgatcttagcttatggcaacctctggctcccgggttcaagtaattctcctgcttcagcctcccgagtagctgggattacaggtatgcaccaccacgcccggctaattttttgtattttgttttagtagagacggggtttcttcacgttggtcaggctgttcttgaactcccgacctcagctgatcctcccgcttcagcctcccaaagtgctgggattacaggcgtgagccactgcgcccggctagatcgtacaatatcttgaaggccattatgctggtgtcttccctttgaagccctcttatattttgttggtgcaaaagtaattatggggtgggcatggtggctcacacccataatcccagcactttgggaggccaaagaggggtggattacttgaagtcaggagttcaagaccagtcttaccaatgtggtgaaaccctgtctctactaaaaatacaaaattagctgggaagactagtttcctagacggggtttcaccatgttgtccaggccgatctcgaactcctgaccttgtgatccgcccacctcagcctcccaaagtgctgggattacagccagccaccgcgagccaccgcgcctggccttattttttattttatcttttttagagacaggatcttgttctgtcacctaggctggagtgcagtggcctgatcatagctcactgcagcctcgaactcttgggtttaagtgatcctcccacctcagcctcctgagtagctaggactacaggcacacatacaccacccctggtggtgtgtgcctgtagtcccaaaccagtctgaaaagatagatgtgggggccaggcgcagtggtgatgcgcgtctgtagtcccagctacaggactgaggcaggagaattccttgagcctaggatttttgttttgttttgtttttttgagacagaatctcgctctgtcgcccaggctggagtgcagtggtaagatctctcagctcactgcaagctccacctcccaggttcacgctattctcctgcctcagtctcccgagtagctgggattacagacgcctgccaccacgcccggctaatgttttgtatttgtagtagagacggggtttcaccgtgttagccaggatggtctcggtctcctgacctcatgatccgcctgctttggcctcccaaagtgctggtattacaggcgtgagccaccgcgcctggcatgagcctaggagttcaaggctgcagtgagctgtgattgtgccactgcacttcagcctgagcgatagagcaagacctacaaaaaacaaacaaaacccaaaacagaatcacatgtaacacacagctgtggactgattggttgacaaaagtgtggtgatcagaggctggcaggaacttcaccatgtatttccgctagaagcaatgttcagtattctctaattcattgtttgtggtgactttggggaatataaccaccacagagacaagaatcaactttgaatgtgtcatcccaccacctgctggcttccgttgtttctgatgagaaatcaactgtcaatctcattggagtttccttgtacgcgatgagttgtttttctcttgctgctgccaagagtctctttttgtcttgtttgtttatttatttatttatctaatttatttattttgagatggagtttcacttttgttgcccaggctgagtgcaatggcacaatctcaactcactgcaacctctgcctcccgggttcaagcaattctcctgcctcagcctcctgagtagccaggactacaggtgtgcgccaccatgcccagctaatatttgtatttttttttttaaattttttgagatggagtctcactctgtcccccaggctagagtgcagtggcgtgatcgtggctcactgcaaactctgcttccctggttcaagcgattctcctgcctcagtagctaggattacaggcacatgccaccacacctggctaattttttatttttagtagaggcagggtttcaccatgttggccaggctggtcacgaactcctgacctcaggtgatccatccaccttggcctcccaaagtgctgggattacaggtgtgaaccgctgtgcccagcctaatttttgtatttttggtagagtggagtttcactatgttggccaggctggtctcgaactcctgacctcaggtgatccacctgcctcggcctcccaagggttgggattacaggtgtgagccaccatgcctggcccttggggtctctttttttatgaactgtctgtcccactgggcaaagcctctgagaccctattttggacactggtggagcagtagcctctggttttcgtggcttgcccctcctggcatgggatctctgttccacaagcaagctgggaggagtgtgattatggtcccagtattcttggactgtcactgatggtacagccttcattctatggtgtgggcgagtgctgggtggaggagaagagtgccctacttctttaccacgttcaccagaaatgtagcctcttcaatttggagttggaggggatgaaaactggtggcagcatgctcctcctggtgagatatggtaagccttgattggcagctgaggggagagggagcttgtcttcttggccacatctactcagagagcagtttccttccagctgaactgtggggggagggcagtcaggagatagttggtcctcctggcttaaatgccacagatggcctggcacagtggctcataatgttacaggtagttaaacaggcatgagcagggctggagagggctcttccccacccaccaggaatgtcaagtgatggttcaacaatgatcacattgcctctctaaataatttggcagccagcgccagagagagagacaagctcctgatggtccacagctgttatgttagagtgttaattgaatgcagacaccagggagaagcaatttcctggacatgtgcattaagagacaaaatagtctgggcacggtggctcacacctgtaatcccagcaatttgggagactgaggcgagcggatcacctgaggtcaggagttcaagaccagtctggccaatgtggtgaaacccccatctctactaaaaatacaaaattagccaagcgtggtgttgggtgcctgatatcccacctactcaggagactgaaggaggagaattgcttgaacccaggaggtggaggttgcagtgagctgagatcaggccactacactccagcctgggaaacaagagtgaaactgtctcaaaaaaaaaacaaacaaacaaaaaagaaagagacaaaatgatggagcatgaccttccggggtcagaccaccggaaaagggaagaaaacctcagataggcatgcatacaacttcctacacacactgtgcatgctcaccttcccagggtaaggaggccactgtgcatgcaggcagcccatcctaagggaagaatcatgggaaaggagccagcctataaagtcctaggatcaaggttgaacaccacgcttgaccttggtgcccacttgagtctcttccaaatgtacttacctttctttcccattctaaagccatttaaaataaacttccactcctgctctgaaacttcccttggtctctttttctgccttatgccctgtggttctttcttctgtggaggcaagaattgaggttgctgcagacccgtacagatttgtcaccggtaacttggataacctttcaccgataacaatgcttataatcccagcactttgggaggccgaggtggcaggatagcttgagcccaggaatttgagaccagcttgtgcaacatagtgaaaccccatctctacaaaataataataataaaagtaataaaattcaatgccacagattctccctgttcttactgagttttagtagattttcttgaataagaaagtgagccaagattgcaccactgcactccagcctgggcaacagagcaagactccatctcaataaaaaataaaattaaatgtttattcatctgttatatgacattaggataattccagaaactttaagtgtttatttatttttaaatggttttcaccagctttgcttgttttgctggggaaaagatcctcagagctccggcactgtcatcttagagctttgatgtcccccagtgtattaatccattcttgtattgctataaatacctaagcctggataatttataaaggcaagaggtttaattggctcatggttctgcaggttgtacagggaacatgatgctggcatctgcttggcttctggggaggcctcaggaaacttacaatcatggcagaaggtgaagggagaacaggcatgtcacatggcaggagcaggagcaagagagcaagggaagaggcgccacacactttacttattttatttttattcatttattttgagatggaatctcactttgtcacccaggctggagtgcagtggcactacctcagctcactgcagcctccatctcttggattcaagtgattcttttgcctcagcctcctgagtagttgggactacaggcatgcgccaccactggctttttttttttttttttttttttttagacagagttttgctcccgttgctcaggctagagtgcaatggcaccatcttggctcaccgcaacctccatctcccaggttcaagcgattctcccacctcagctgccaagtagctgggattacaggcatgcgccaccacatccggctaattttgtatttttagtagagacggggtttctccatgttggtcaggctggtatcgaactcttgatctcaggtgatctgcccgcctcggcctcccaaagggctaggattacaggcgcgagccaccgtgcctggccaatttttttttttttttttttagatggagtttcgctctcgttgcctaggctggagtgcaatggtgccatctcggctcactgcaacctccgcctcctgggttcaagcaattctcctgcctcagcctccctagtagctgggattacaggcatgcgccacctcgcctggctaattttgtatttttagtagagatggggtttctccatgttggtcaagctggtctcgaactcctgacctcaggtgatccacctgcctcggcctcctaaatagctgggattacaggcgtgagccaccacatctggcctaatttttgtatttttagtagagacgggcgtttcaccatgttgcccaggctggtctcgaactcctggcctcaagtgatctacccacctcggcctcccaaagtgctgggattacaggtgtgagccactgcgacccgccttcacacacttttaaacaaccagatctcttgagtactcactcactgtcaagagaacagcaccaaagggatggcgctaaaccattcatgagaaaccccacccccatgatccaatcacctcccaccaggccctacctccaacactggggattgcaatacgacatgagatttgggtgggcacacagttctaaaccacatccctcagcttttcctttcaggcttttgggttagtctattgcttgctccaacacctgtctactacttcagacagtctcaaagttaaaaatcctacctgttatccaatgaagtctccctgaaaaaaaatcttgcctgtaaatgtttctgatgaatgcctcctggggagagggccttttgcactgggccagctccagtgaggtcacatacagatggacttgcaagtggagtcttctagggaacctcaagacagctccagtaatgacagttctttggaaacacaactttgaaagaactccagctccgttttactccctcagggggctgccaggttgctctgagaatgtgggctgttattttttaaggttgcaacagagctggaggctgtgggctgggactagggcaatttttttttactttatttatgttacctttcttttttgagacagggtcttgctctgtcgcccaggctggagtgcagtggcacgatctcttctcactgcagtctccacctcctgggttcaagtggttcttctgcctcagcctcacaagtagctgggattacaggtgcacaccaccacgcctggctaacttttgtattttttggtagagatggggtttcaccatgttggccaggctggtttcaaactcctgacctcaagtgatccacctgcctcggcctcccaaagtgctgggattacaggcgctcaagccaccttgcccagccactttttaaaatttcttgaaagccacaacaagatttgcctatccccggtactttccccatttttaaaaatttctcaaaggtggtcttcagtggttccaaaactttatcttagaaactttcagcattttgaggggtggactgcatccaaatctggggtcttgaacatttcagttgagttagtgtcctattatcattctccacttctttggggcttcaatttccactgaagtgtggacctaaaagcattttaatcttgagtgtcattctctttacagaaaacacaggctgggcactgtggctcacgcctgtaatcctagtactttgggaggctgaggcaggcggatcacgaagtcaagagattgagaccatcctggacaacatggtgaaaccctgcctctactaaaaatacaaaaattagctgggcgtagtggcacacgcctgtagtcccaactactcgggaggctgaaacaggagaattgcttgaaaccaggaggcagagaggttgcagtgagccgagatcatgccactgcactccagcctggcgacagagcaaaaatccatctcaaaaaaaaaaaaaaaaaaaaagagagagagagagaaaacacaaaccaggcttgacacagtggctcattcctgtaatcccaggactttaggaggctgagacgggtgaatccttgagcccaggagttttttcttttctttttctttctttttttttttttttttttttttttttttttttttttttgagacggagtctcactctgtcgcccaggctggagtgcagtggtgtgatctcggctcactgcaacctccgcctcctgggttcaagcaattctcctgcctcagcctcccgagtagctgggactacaagcgcatgccaccacgcccagctaatttttttgtatttttagtagagacgaggtttcaccatgttagccaggatggtcttgatctcctgacctcatgatccgctcgcctcggcctcccaaagtgctgggattacaggtgtgagccaccacacccagccaagtttttttcttttcttttctttctttcttttttttttttttttcctaagacggagtctcattctgtcgcccaggctggagtgtaatggtgggaactcaactcactgaggcctctgtctgctaaattcaagcaattctcgtgcttcagcctcccgagtagctgggattataggtgcgtgccaccacgcccggctaatttttgtatgtagagacggggtttcaccctgttggctaggctggttgaactcctgacctcaagtgatctgctcacttcggcttcccaaagtgctgggattacaggcgtgagccactgtgccaggccgagccaagagttcaaaactagcctgggcaacataggaagactccagctctataaataaataaataagctgagcatggcagtgcatgcctgtagtcccagctacttgggaggctgaagtgggaggatccctggagcctggaaggtggaggctgcagtgagctatgattgcaccactgcgctccagcctggggaacagagtgagagagcctgtctcaaaaaaaaaaaagaaaaaagaaagaaaaaagaaaaaagagaaactaaatgaaagtggagagcttctgcttcctcttggtcatctgttcgtattacaacatctaccctaagcaatgggcctatttcttcctttttcttgatccagatatagctatcaaagccctttttgttgtctatagcatgttttgtaatctcagctcattccgagttacagccatcccgacactgttctcataggtttatgctcagcttttgtgtttatccctgggttacgcggctcttcttacatcttcttttattacagaacttcctgtgcagccgctttggctcctataaatgctattccgattgcctcttcatcaggacccaaaagggatgaaggagtggctggttttttggggaggcgggaggaggttggatattcttgaaatgataaataaaatgatacatattagttcagtattggaacacagataaatatttagcacatgcaatgagataattgttcattaatttagcatcctatgattaatttagcatcctaatagtcataggcattgtcttgttcacctcaagtacattaatacacaattacatactgctttttcccttagctttcatttatttacgactgtgtggtaaacgatcctaaaatttagtggcatgaaacaaccaccttttaaaattttttttcaaatgctcgttgattctgtgggtggagtttgggaagggcaaagtgggaaaagctatactctgctctgtgatgtctgagcctcagcctcagatggggtgacccgaacagccaacagtaactctaatggatggggagggaacagccggggctggggatctgcttcgcagatggctgctttagtcacatgcctgttgcctgcgctgcagtggcaggagggtaggctcaggcccaaaggggactgaaaaccacgcagcctgtgtgtaagggggcaacccgtatgcgaaagcacagttggactttttttttttttttttttttgagacaagagtctcactctgtcaccctggctggagtgcagtggtgtgatctcaactcactgcaacctctgcctcctgggttcaagtgattctcctgcctcagcctccgagtagctgccattacaggctcccaccaccacacctggctaatttttgtatttttagtagagatggggtttcaccatgttggccatgatggtctcgaactcctgccctcagaggatccacctgccaaagtgctgggattataggtgtgagccaccatgccaggccttttcttttctttttttctgaggcagggtctcagtctgtcacccaggctggagggcagtggtgcaatctcagctcactgcagtctctacctcctgggctccagcaatcctcccatctcagcctctcaactacaggtgtgcgccactatgcctgtctaactttttttttttttttttttttttgagaaagaatttcgctctccttgcccaggctagagtgcaatggcgtgatctcggcttactgcaacctctgcctcccaggttcaagtgtttctcctgcttcagcttctgagtagctgggattacaggcatgcaccaccatgcctggctaattttgtatttttagtagagacggggtttctccatattggccaggatggtctcaaactcctgacctcaggtgatccgcccgcctcggccttctggctaatttttttacagattttttgtggagactcagtacattgcccaggccggtctggaacttgtgggctcaagtcatcctcccacttatgcctcccaaagttctgggattacaggtgtcagccactgcacctggccggccggccttccttccttccttccttctttccttcctttcctttctttttttgttgagacggagtctcgctctgtcacccaggctggagtgcagtggtgcaatctcagctcactgcaacctctgcctcctaggttcaagcaattttcctgcctcagcctcccaagtagctgggattacaggcgtgcgccactgcgccagctgatttttgtattttcagtagagacagggtttcaccatgttggccaggctggtctcgaactcctgacctcaagtgatctgcccacctcagcctccaaagtgctgggattacaggcatgaatcacggcacctggcctcctggcttttctttttctttgagacaaggtctcactctgtctcccaggctggagtgcagtggtgtgatcattgctcactgcagccttgaactcctgggctgaagcaatcctcccatttcagcccctcaagtggctaggagtacaggtgcatgccaccatatccagctaattttttcaattttttgtaaagatggagtcttatcatgttgcccaggcttgtcttgaactcctgggctcaagtgatcctcccgcctcggcctcccaaagtgctgggattataggcatgagccgctgaagctgggctctataggcgtattatgaaaaaccagggctccttcatgacccatttcctgttccccagaggcaagaacgttccaccgctttggctgggccattggtattgacttccatgtctctaaacagcatgttcatattgtacttgctgatttctcggttttaggcactacctgttatcattttgaaggttgaggctttacaattcttccacctctccccgacagcccacatctctattcctacatatgcacgtgtgcacttcctgttttcattcttccatgtcactgtgcctcggttctgggtacacagatattcagagtctatatcctatagctatgtaaacactgttcacagctgaaccatgccctttccacaaacacttcttccctgcactgtttgttccttctttcccctccaccacactgagttcattatgtcacattttagctgctgtgtttttttgctatgtaacactagttcaatcctgaatgctaccttgagatgtcaatcctttatcacattcaaacatattccattttctattggttttatttcatattattttgttttgttttattttgagatagggtcttgctctgtaccggaggctggagtgcagtggtgcaatcacagctcactgcagcttcagcttcctgggctccaagcagtcctcccacctcagcccccagaatagctgggactacacatgcgtgccactacacccgactaatttttaaattttttgtagagacagggtcttgcaatgttgcccaggctggtcttgaattcctgagctcaagtgatcttcctgcctcagcctcccaatgtgctgggattactggcatcagccacctcgcccagctgcaccatgtatgcatttctaaacaggcttagttcctgcctgttttgggctttataagaacgcactcatggccagacacagtggctcacgcctgtaatcccagcactttcagaggccaaggtggatggatcatgaggtcagaagttcgagaccagcctggccaacatagtgaaaccctgtctctactaaaaatacaaaaattagccgggcatggtcttgcacgcctgtagtcccagctactctggaggctgaggcaggagaatcacttgaacccgggaggcagaggttgtggtgagccgagattgtgccactgcactccagcctgggcaacagagctagactctgtctcaaaaaaaagaatgcactcattgtaggctgggtgtggtagctcacgcctgcacgcctgtaatcccacactttgggaggctgaggcgggtggatcacctgaggtcaggagttagagactagcctggccaacatagtgaaaccccatctctactaaaaatacaaaaattggccaggcgcacatctgtaatcccagcactttgggaggccaaggcaggcggatcatctgaggtcaggagtttgagaccagcctgaccaacatggagaaaccccgtctctactaaaagtacaaaaaattagccgggcgtgatggcacaaggctgtaatcccagctactcgggaggctgaggcaggagaattgcttaaacccagaaggtggaggttgcggtgagccgagattgcaccactgcactccagcttgggtgacagagcaagactccgtctcaaaaaaaaataaataaataaaaagttaattgtgattgtggtagaatacacacaacataaatgtacctttttttttttttttttttttgagacagagtctcgctttcttggccaggctggagtgcagtggcacgatctccactcactgcagcctccatctcccaggctcaagcaattctcctgcctcagcctcccgagtagctgggattacaggtgtgtgccaccacgtccggctaatttttgtatttgtagtagagacagggtttcaccatgctggcctggctggtctggaactcctgacctcaggtgatccacccactttggccttccaaagtgctgggattacagatgtgcgcctggccaatttttgtatttttagtagagatggggtttcaccatgttggccaggctagtctccaactcctgacctcaggtgatccacccgcctcggcctcccaaagtaccatctgagccattttttagtgttcagttcagtggtgttgagtacattcacactgtggtgcaaccaatctccagaactcttcatcttgcaaaactgaaactctgaacccactaaacaacaactcccctctctcccctcccctcagcccctggcaaccatcactctactttctatctctatgactctgactccaggtacctcacataagtggaatcatgcagtatatgtcttttggggacagggttatttcacatagtataatgtcctcaaagttcagccatgttgtagcatgtatcaaaatttcctattttaaaaaaaattctgaataatattccactgtatgtaggtagcacagtttgtttatccattcaccctttcagcctctgtctttattattattattattattttgagacagtcttgctctgttgcccagactggaatgcaatggcgagatctcagctcactgcaacctccgcctcccgggttccagtgattctcctgcctttgcctcctgagtagctgggattacaggtgcccgccaccatatgcctggctaatttttgtatatttagtagagacggggtttcaccatgttgaccaggctggtctcgaactcctgacctcatgacccgcccgcctcggcctcccaaagtgctgggattacaggtgtgagccaccgctcccgaacctgtcttctatattggatgccttcctcaaacgtggtgaatcttgggggtctgtgcatactaaagctggagctattaaaagccttttaaaagttccccaggctgagggcacagtggctcatgcctgcaatcccagcactttgggaggccaagacaggtggatctcttgagtccaggagttcaagaccagcctgggtaacataacaagacctcatcgctacaaaaaataaaaaaataaagctgaccatggtggctcacgcctgtaatctcagcactttgggaggccaaggcgggcgggtcatgaggtcaggagttcgagatctgtctggtcaacatggtgaaaccccatctccattaaaaatacaaaaattagccaggcgtggtggtggatgcctgtaatcccaactactcaggaggctgaggcaagagaatcacttgaacagggaggcagaggttgcagtgagctgagatcgtgcctctgcacttcagccggggcgacagagtaagtctccatctcaaaaaaaaataagaaaaaaaataaatcaggcacggtggtgcacacttgtagtcccagataccaggaaggctgaggtgggaggacgatcgagcccacgagtttgaggttgcagtgagctgtaattgtgctactgcactgcagcctgggtgacagagtgagacccaatctcaaaaacaaacaaacaaacaaaaaaaaaacctctctccactgtgtggcactgtgtgctagggggtgaccttgctggtggcttcccagggagctcctgatgtcagtgtcttcaggactttcctcttggcttgatcacagtcccttcagaagattcttccaattcctgcctgaaggtgccaatttctatgtcttttgtggcttctgcaaagaaaacctagcaatttctcattttttccaatgccagctcgattccacttccttggttctagtaaattggttaccatgagtccctctattagtacctggcttaaacatttttgttcgtattgtcttctttcctattcttactcttcctgtgggtgtgtggcattagaaagattctcttactgccattttattatgtttggggcaagaacagaagtaaatacatgtgtttagtctactatctttaacctgatgccttttaacttttttttttttttgaggtggagttttactcttgtcacctaggctggagtgcaatggtgtgatcttggctcactgcaacctctgcctcctgggttcaagcgattctcctgcctcagcctcccgagtagctggggttacaggcgcctgccaccatgcctggctaattttttttttttttttagtagagacagggtttcaccatgttggccaggctggtcttgaactcctggcctcaggtgatttgcccgcctcggcctcccaaggtgctgggattataagcgtgagccactgtgcctggccccttctaactttttaaaagtaaaccttgtcttggttaggcatggtggctcatgtctgtaatcacaaaattttgggaggctaaggcaggaggattgcttgaggccaggagttagagaccagcctgggcaacagagtgagactgtctctacataaaatttaaaaaaatagccaggtgtggtggtacatgcctatagtcccagtgctttgggaggccaaggcaggaggatcacttgaacctaggaattcaaggccacagtgagctgtgattgcaccactgcattccagcctgggtaacagagcaagaccctgtcttgaaggaaaaaaaaagagttgtcatattcttaccacatcattatccacattatccacaaagcaaagatatggaatcaacctaagtatctatcaatggaggagtggataaatcaactatggtatgtatacagaatggaatactatttgactataaaacagaattaggctgggcatgatggcccacacctgtaatcctagcacattgggaggcgaacacaggtggattgcttcagcccaggagttcgagaccagcatggccaacatggagaaaccccacctctactggaaaaaaaaaaaaattagccaggcgtggtggcaggtgcctataatccctgctacttcagagactgaggcaagagaattgcttgaacctgggaagcagaggttgcactgagccaagatcactgcactccagcctgggccacagagcaacactcagtctcaaaaaaaaaaaaaaaagttttaatatctgatagcagagtagggtgattatagttggctgcaatgaattgtatatttcaaagtaactagaagagaacttgaattactcccaacccataggaatgagaaatactcaaggtgatgagtaccccagataccctggcttgatcattacacattctatgcatgtaacaaatactctcatggaccccataagcatggtgtatatatatatgacatatatgatatatcatatgcaacacatattatatcatatatgatataatatatgtgatatatcatatatgatatataatatatgtgatatatcatatatcatatataatatatgcgatatatcatatatcatatataatatatgtgatatatatcacatataatatatgtgatatattatgtatcacatataatatatgtgatatattatgtatcatatataatatatgtgatatattatgtatcatatataatatatgtggtatattatgtatcatatataatatatgtggtatatgtgatatatattatatatgatatgtgtgatatattatataatatatgtgatatattatatatgtgagatatatataatatatatatttcttttttagacagcatcttgttctgttgcccaggctggagtgcaattgcacaatcttggctcactgcaacctccgcctcctggtttcaagcaattctcctgccttagcctcccgagtagctgggattacaggcgaccgccaccacacccagctaattttagtatttttaatagagatggggtttcaccatattggtcaggctggttttgaattcctgatgttaggtgatccacctgctttggcctctcaaagtgctgggattacaggtgtgagccactgcgcctggcctggaatacattatgtatcaataaaaaaaaacaggagttgtgtggagaacaattggagcagcagatggcaaagaagaccttgagggctgggataagaagactggattttctgctagaaggaatgagagcattttatcatgttagtcagcttcagagccttgcagtaaaaacatttgcacatttgaatgttgatgaagacatttacaaatatagacaggatgtgataatttgtacttttccctcatccccggttggtgtgagtgatgtcattgattgcaccagttaacaggtgaaaaaatagaagtttgggatgtcaggattgtacctgatgcttgagcatcataggtggatgtgaaggaaaaggaaaacatgatcaagggctgagcaatctgggccacaggaatatcaaactcatttaccaatgtgtgcagccacccttaggctgcatgacagattgaggacagagcttatctgggcactcattaattgaaaggaggagatcagtgagaagaagtagagaaaacaaactacttgtcagttcaaacttaatcactttgttttttgagacagagtctcgcactttcgcccaggctggagtgcagtggcatgatctcggctcactgcaagctccgcctcccgggttcatgccattctcctgcctcagcctcctgaatagctgggactacaggcacccgccaccacgcccggctaattttttgtatttttagtagagacggggtttcgccgtgttaaccaggatggtctcgatctcctgaccccgtgatcccccgacctcggcctcccaaagtgctaggattacaggtgtgagcccccgcgcccggtcttttttttttttttttttttgagacaaagtcttgctctgttgtccaggctggagtgcagtggcatgatgtcagctcactgcaacctctgcctgtggggttcaagagattctcctgcctcagcctcccaagtacctgggattataggcacccgccaccacacccgactaatttttgtatttttagtagagacagggtttcacatgttggccaggctggtctccaactcctgacctcaggtgatccacctgccttggcctcccaaagtgctgggattacaggtgtgagccaccacgtccagctttttttttttttttttgagatgtagtcttgctctgtcacccaggctggagtgcagtggctcaatctatgttcactgcaacctccgcctcctaggttcaagtgattctcctgcctcaaactcctgagtggctgggattacaggtgcgtgacaccacgcccagctaatttttgtatttttagtagagagagggttttaccatgttggccaggctggtctcaaattcctggcctcaggtgatctgcccggctcaggctcccaaagggctgcgaatccaggcgtgagccaccgtgcccggcccggtttatattttagaagggtaatacagtaagttgacagtaagagagcccttatctcttttcttttccttttttgttctcctttcatattccatcattgaaaggtaggaacatacagcataacttaaaattaggaacagagttcacatataactttttttttttttttttttgagatggagtcttgctctgtcaccaggctggagtgcagtggcgcaatcttggctcactgcaacctctgcctcccaggttcaagcaattcttctgcctcagcctcttgagtagctgggactacaggcacgtgccaccacacccagctaattttttttgtatttttagtagagacgcggtttcatcatgttggtgaggctggactcgatctcctgatcttgggatccacccgccttggcttcccaaaatgctgggattacaggcatgaaccaccacacccagccaccttttttttttttttctttttctttttgaagacagaatcttgctctgttgcccaagctggagtgcagtggcgcaatctcagctcaatgtagcccccacctcctgggttcaagtgagtctcctgcctcaggctcccgagcagctgggattacaggcatccgccatcacacctggctaatttttgtatttttagtacagacgaggtttcaccatgttggtcaggctggtctcgaactcctgacctcaagtgatccgcccgcctcagcctctcaaagtgctaggattactggtgtgagccactgcgcctggcccatataacctttttaaaaaataacagctttattggaatataaaacatacaccattaagtttaccctttcaaagtgtacagtttggtgggtttggtttttagttgattcacaaagttcatctgtcaccactatgtaattccaaaatattttcaccccaggaagaaactctatactaattggcagccactccctgtcccctccctactccccaagtccctggcaaccactaatctaattattgtctccatggatttgcctattctggacagaccacatgtaaagtttttgcttaatctgattaattgataggttccacttttacagataaatagcttttcatgtcagcaaaaatgaaagatttaaaatgtagtactaggctggtcacagtggctcacgcctgtaatcctaacactttgggaggccaagctaggtggatcacttgagctcaggcattcaacaccagcttgagcaacatggcaaaacccggtctctacaacaaatacaaaaaattagccgggtgtggtggtgcatgcctgtgctctcagctcccagctacttgggaagctgaggtgggaggatcacttgaccctgggaggcagagattgcagtgagccaagatcacactactgcattccagcctgggcaacagagtgagaccccatctcaaaaaaaaaaaaaatatatatatatatatatgtagtacctgacctcccccaaagttatttgaggttcaaatgatttatttcagcctccacttaactagagctgacctcttattagacaccttggggacattactatgagccttaaagaaataaaaagtattataaaggaatacaataaatagttgtatgccaattaattaaacaacttagaaaaatggacaaagtcctagaaaaacaagaaaaacctaccaaatttcaggaagaaatggaaattctgaatagacatataacaagtaaatagattgaagtagtaataaaaaacttcccacaggttggcgtggtggctcatgcctgtaatcccagcactttgggaggccgaggtgggcagaccacgaggtcaagagatcaagactatcctggctaacaccgtaaaaccccgtctctactaaaaaaaaattagccaggcattgtggtgggtgcctgtagtcccagctacatgggaagctgaggcaggagaatggtgtgaacccaggaggtggagcttgcagtgagatgagatcgtgccactgcactccagcctgggcaacagagcgagactccctctcgagagaaaaaacaaaaacaaaaacaaaaacttccacaaaggctcatgcccacagggcttcactgctgtatttaactaaacatttagagaaaaattaataccagtttttcataaactctttcaaaaaatagaagaagaggcaacatttcccaactctttttatgaggccagtattaccctgatgccaaagccagacataagaaaggaaactacagatcagtatttcttattaatatagaggcaaaaatcttcaaataccagcagacagaatccagcaccacatcaaaaggacagtacaccatgatcaagtgcgaatgatcccaggaatgcaaggctggttcaatatctgaaaatacattaacttaatacaccataattttagaataaatggaaaaaagcaattaatcatctcaataaatgcagaaaaaaactttgacaaaattcaacattctttcgtaagaaaaaaaccatgcaacaaactacaagtaaaagacaacttcctctacctgataaagagcatctgtgaaaaacccacagctgacatcatacttaatggtgaaagttcctgacagatcaaaataagacaaggaagtccgctcttaccacttttattctgtattgtactggagattctagccaggaaaattaagcaagaaagtgaaataaaaggcatctagattggaaagaaagaagtgaaactatctatagattacatgatcttgtatatagaaaatatacaagatccaaggccgggcgtggtggcttatgcctgtaatgccagcatttgggaggccaaagtgggcagatcatttgagatcagcagtttgagaccagcctggcaaacatggtgaaactccgtctctactaaaaatacaaaaaattagctgggcatggtggtgcacacctgtaatcccagctactcagagtctgaggcaggagaatcccttgaagctggtaggcagagtttgcagtgagctgagatcgtgccactgcactccagcctgggtgacagagtcagactctgtctcaaacaaaacaaaacaaaaacaaaaaaagaaaatatataagatcctgtaaatcctaaggaacccactaaaaaatcagaactttaatcgccagggaaatgcaaatcaaaacctctgaagaaaaaacacaaactgttttttttcttggctctcacaccacagtaacaatcactacagaagtcttctgtgaccgggctgggtgcggtggctcacatctgtaatcccagcactttgggaggccaaggtgggtggatcacgaggtcaggagttcaagaacagcctgaccaacgtggtgaaaacctatctctactaaaaacacaaaaagaatagccaggtgtggtggcaggcacctgtaatcccagctactggggaggctgaggcaggagaaatgcttgaaccagggaagcagaggttgcagtgagcagagatcacaccactgaactccagcctgggcaacagagtgagacttggtctcaaaaaaaaaagaaaagaaaaggaaaagaaaaaagaaaaaaaaaagaagtcttctgtgaccaaatgttggggggaactcctgccaacaccaagcaaacaaccaattctccaatggacaattctgaattgagtgtcctccaattcaattccaacactatctacctgaagatagcatcagatcccacaagttgagggttcaatcccacaagactgcacccctacacacaccagaacttctgaccgactggcttcaaattggggtttccatgattccctcttttttttttttttttttttttttttttgagacagagtctcctctgccacccatgctggagtgcagtggcagagatctcagctcactgcaagctccgcctcccaggttcatgccgttctcctgcctcagcctcctgagtagctgggactacaggtgcatgccacaacgcccagctaattttttgtatttttagtagagatggggtttcactgtgttagccagagatggtttcgatctcctgacctcgtgatccgtccgcctcggccttccaaagtgctggggttacaggcatgagccaccatgtctggcacagctctctctttagtgagagtggggacttctgagaggaaaagaccagcaggtgggggatgtgccatattttatagtcagatttgaggatgtggtgcctgatttacataggactcacagattggtttgatcaagagtgatattacatagcatgcagggaaggctggctgcctcaccctaatcatattatgcaaatgaactttccccttggccttcgccatcttgtctgctctttactgtacacgtggctgacaaagagaagggaagatggagccaccatcttgaacatgattggcacaactgccaacatctatgtctgcagctcgattttacaggctactcttcgttagaaaggaaaataatttggggctgcttttcattaaaaggagaaccttaccaaagacttctgtacccttactatctgcctaagtaatttcttcttaactcctgtatgacctccacatggtcagctatccggaagctccctaagccctgtccttttggccttttatggagacttaattggataggcatgactcaagcatggacaaatgtgtagaaaggtgattggtcaaaaagggcacgatctaatactaataccctgaatggggaaccccagcaaggcccttgtgttcagcaactccttggcctctctgtgcagctttccttcctccagggtatgggcaggagtcctaccgaaatgaaggtgtcatcaactacactcagacaaggtatgtcagagagtttctttatggccaatttcaatacagaaaggtaggggaagattcctgccttggtgagaaaaagaagcaggtgaaaggagagcaggagaaggtcaaacagagagagagagtttttttttttttttttgagacggattcttgctctgttgctcaggctagagtgcagtgatctccgctcacactaacctccgcctcccaggttcaagcgattctcctgcttcagcctcctaactgggactacaggcgcccgccaccacacctggctaatttttgtatttgtagtaaagacggggtttcaccatgttggccaggctggtcttgaactcccgacctcgtgattcacccaccttggcctcccaaagagctgggattacaggcatgagccaccacacccagccaagagattcttttttcaatgaggcctgcttcagaggattgcagcactccagcattctagcaagagctatgggagctgtgaaccaggaactgtggacaaaatctagatgtatatatatatatatcaccaaatcacaatgaggtgctgcctcatacctgttacgatggccactatagaaaacaaaaacaaaaaacaccaaaaccagaaaatacgtgtggcaagaatgagagcgaattggaaaccccgtgcactgttggtgggaatgtaaaatggtacagctaatgtggaaaactgtgtgaaagttcctcaaaatattaaaaatagaactaccatatgatccagcagtcccacttttgggtatttatttatttatttatttatttatttatttatttatttttgagacggagcttcgctcttgtcacccagaatggagtacaatggtgcgatcttggctcacaggaacctccgcctcctgggttcatgcgattcttgtgccttggtctctcaagcagctgggactacaggggtgtgctatcacgtccagctaatttgtgtgtgtgtgtgtgtgtgtgtgtgtgtctgtgtatgttttttgagacagagtctcactctgtcgcccaggctggagtgcagtggtgtgatcttggctcattacaacctccatcttccgggttcaagtgattctcctgcctcagcctcctgagtagctgggattacaggcatctgccaccatgcagactaatttttatatttttagtagagacggggtttcaccatgttggccaagctggtctcaaactcctgacctcaggtcatccacccacctcagcctcccaaagtgctgggattacaggcatgagccatgtgcccggcctaatttttgtgttttcagtagagacagggtttcaccatgtcagccaggctggtcttgaactcctgacctcaagtgatccacacacctcagcctcccaaagtgctgggattacaggcatgagccacgtgcccggcctaatttttgtgttttcagtagagacagggtttcaccatgtcagccaggctggtcttgaactcctgacctcaagtgatccacccacctcggcctcccaaagtgctggaattacaggtgtgagccactgcgcctggccacttctgggtatttatccaaaagaattgaaatcagaatctcaaagagatatctgcattcccatgttcatttcagtattatttacaataatcaagaggtgtacacaacctaaatgtccactaacagatgaatggataaagaaaatgtgaggccaaggtgggcggatcacgaggtcaggagattgagaccatcctggctaacacggtgaaaccccatctctactaaaaatacaaaaaattagccaggtgtggtggcgggcgcctgtagtcccagctactcaggaggctgaggcaggagaatggcgtgaacccgggaggtggagcttgcagtgagctgagattgcgccactgcgctccagcctgggtgatggagcaagattccatctcaaaaaaaaagaaagaaagaaagaaagaaaatgtggcacagacatacaatggaatattattcagctgtaaaaaggaggaaatcttgtcatatgctacaacacagatgaaccctgaagactgatacagtttcgatgtgtgtctctgcccaaatctcttgtagaaatgcaatccccaatgttggaggtggggcctgtggggaagtgtttggatcacgggggcagatccctcataaatggcttgcgccatctccttagcaataagtgagcccttactctgagttcacacgagatctgactctttaaaagttagtggcacccctcctcaccctctcgctgtcttgctcctgttttcgccatgacatgcctgctccccattcgccttctgccatgattttaagtttcctggggcctccccagaagccaagcagatgccagcaccatgcttcctgtacagcctgcagaaccatgagccaattaaacctcttttcaccgtaaattacccagtctccggcatttctttatagcaaagcaagaatggcttaagacaaagacattatactaagtgaaataaaccagttatagaaggacaaaaactgcatgattccactcatacgaggtatctaaagtagtcaaactcaccaaaacaaaaattagaaaggtgatgttcagcagctgaggggagggggagaggaggagttgctgtttattgggtatcgagtttcagtcatgcaaaatgaaaaattttagaatctgctgcactacgttgtgatcgtagtttaaagtactgtacacttaaaacttgctcgggtccaggtgtggtagctcatgcctgtaatcccagcacgttaggaggccgaggcgggcggatcacgaggtcaggagatcgagaccatcctggccaacatggcaaaaccccgtctctactaaaaaataaataaataaaaattagctggggatggttgcgtggcatggaggctgaggcaggagaattgccggaacccgggaggcagaggccacagtgagccaagatcgtgccactgccccctagcctgggcgacagagtaagactccatcaaaagcaaacaaacaaacaaaaatcaacaacaaaaacttgctaggagggtacatctcatgttatatgttttatcacaataagaaaataaaactggccaggcacagtggctcacacctgtaatcccagcactttgggaggctgagatggaaggatctcttgagcccaggagtacgagaccatcctgggcaacaccgtgaaacccccgtctcgacaaaaataaacaaaatcagctgggcatggtggtgcatgcatgtggtctcagctatttgggaggctgaagagagagaattacttgagcctgggaggttgaggctgcagtaagccaagatcgcaccactgtactcctgcctgggcaatagagatagacactgtctaaaaaaaaaaaaaaaaaaaggccaaggtcaggtgaggtggctcatgcctgtaatcctagcactttgagaggccaaggtgggtgggtcacctgaggtcaggagatggaggccagcttggccaacatggtgaaactccatctctactaaaaaaatacaaaaatgagctaggcgtggtggcacgcacctataatcccagctactgaggaggctgaggcaggagaattgcttgaacatggggtgcggaggttgcagtgagccgacatcatgccacttcactccagcctgtgtgacagagcgagactccatctgaaaaacaaaaaacaaaaaacaaactaattaatgaaaacagtaatgttgcaagatataggtcaatatgcaaaaaaaaaatcaattatatttccatataattgcaatggacaggtcaggcacgtttgctcacagctgtaatcccagcactttgggaggccaaggcgggcagatcacttgaggtcaggagttcgagaccagcctggccaacatgatgaaatcccatctctactaataatacaaaaacaaacaaacaaaaaaattagccaggcatggtggtcggcacctgcaatcccaactactagagaggctgaggcaggagaatagcttgaatctgagaggtggaggttgtggtgagccgagaatgcaccattgcactccagcctgggcgacaagagtgacatttcatctcaaaaaaaaaaaaaaaaaaaaaagccgggtgtggtggctcatgcctgtaatcccagaactttgggaggctgaggtgggtggatcacgaggtcaggagatagagaccatcctggccaacatggtgaaaccccgtctctactaaaaatacaaaaaaattagctgggtgtggtggcgcatgcctgtaatcccagctactcaggaggctgaggcaggagaatcgcttgaaccagggagttggaggttgcaatgagctgagatcgtgccactgcactccagcctggtgacagagcgagaccccgtctcaaaaaaaaaaaaaaaaatgcaatgaacaatttctgaaaacgaaattaagaaaacaattccatttacaatagcacccccaaaataaaatacttaagaataaacttaacaaaaggagtacaaaatgtatgctctgaaaccttgaaataattgttgaaacaaatcaaagaagatttgatttctaagtaaatggaaagataccccacattcatggatcagaagatttaatattgttaaattaatctacccaatccctattggaattccagtgacttccttgtagaaattgacaaatgggtcctaaaattcatatggaaactcaggggactcagaatagccaaaacaatcttgaaaaagaaacaagttgaaggctcacacttcccaatttcaaaacttactacaaagctacagtaatcaagacactgtgatactgtcatagggctagacccatagatcaatgatctatagagtccatggctggatgtggtggctcacagctataatcccagcactttgggaggctgaggtgggtggatcacttgaggtcaggagttcgagaccagcctggccaacatggtgaaaccccatctctactaaaaatacaaaaattagccaggtgtggaggtgggcacctgtagtcccagctacatgggaggctgaggcaggagaatcacttgaaccctgagtgacagactctgcctcaaaaaaaaaaaaatctagagtccagaaataaacctatatgtctgtggtcaatttattttaaataagggtgccaagacaattcaatgagggaaagaatagtctttaaataaacagtgctatgtaacagtgaacatgtacaaaacatacacatacaaaataatgaacttgactgggcatggttgctcatgcctgtaatcccagcactttgggagcccgaggtgggtggatcacttgaccccaggagtttgagactagcctgaacaacatagtgaaactcctgtcccacaaaaaatacaaaaagataagcaaggcatggtggtgtgtgcctgtagtcccaactacttaggagactgaggtgggaggatcacctgagcccaagagttcaaggctgcagtgagttgtgatcacaccactgcactccagcctgggcagcagagtaagatcctgtttcaaaaaataataaataaataaggaatgtggagcccctgcctcataccatatacaaaaattaactcaaaatagggttgttgttgttttaaaaccaaatgtaaaagctaaaactataaaactcttagaagaaaacatagggacaagtctttgtagcttcaaatttggcagtgtcttttttttttttttttgagacggagtcttgctctgttgcccaggctggagtgcagcagcacaatctcggttcactgcaagctcggcctcccaggttcacaccattctcctgcctcagcctcccgagtagctgggactacaggcgcccaccaccacacccggctaattttttgtgtatttagtagaaacggggtttcaccatgttagccaggatgttctccatctcctgacgttgtgatccgggtgcctcggcctcccaaagtgctgggattacaggcatgagccaccgcacccatcccggcagtgtcttcttagacatgtcaacaaaaaggaaagcaacaacaatgaaaacagatacattgggcttcatcaaaatgtgaaacttataacatacactggggcctgtcggggggtcgggggagcaagagcattaggataaagctaatgtattcagggcttaatacataagtgatgggttgataggtgcagcaaagcaccatggcacacgtttacctatgtaacaaacctgtacatcctgcacgtgtatcccaggatttaaaataaaatatagaaaatactcaacaatcataataagtgtaaaagaattttggtcgggcgcagtggctcacgcctgtaatcccagcactttgggaggccaaggcaggtggatcacgaggtcaggagatccagaccatcctgactaacacggcaaaaccctgtctctactaaaaatacaaaaataaaataaaataaaataaaaataaataaaaataaaaattagcggggtgtggtggctggtgcctgtagtcccagctactcaggaggctgaggcaggagaatggtgtgaacccaggaggcggagcttgcagtgagccgagatcgtgccactgcattccagactgggggacagagtgagactctgtctcaaaaaaaaaaaaaaaaaaaagaatttgaaacaaaaacgtgaaacttctgtgattcaaagaacaccgtcaagaaagtgaaaaaacgcctgcctgcccgcctttctttctctctctctctctctttctttctttcaacagtctccctctgttgccgaggctggactatactgccgtgatctcggctcgctgcaacctccctgcctcaggctcctgtgattctcctgcctcggcctgccgagtgcctgggattgcaggcatgcgccgccacgcctgactggtttttgtatttttggtggagacggggtttcgccgtgttggccgggctggtctccagctcctgaccttgagtgatctgcccgtctcagcctcctgaggtgctgggattgcagacggagtctcgctcactcaatgctcaatgttgcccaggctggagtgcagtggcgtgatctcggctcgctaaaacctccacctcccagccgcctgccttggcctcctaaagtgctaagattacagcctctgcccggccgccaccccgtctgggaagtgaggagcgcttctgcccggccgccaccccgtctgtgctgggtgtggtggtgggcgcctgtagtcccagctttttggaaggctgaggcaggagaatcgcttgaacccaggaggcggaggttgctgtgagctgagattacaccactgcactccagcctgggcgacagagcaagactccatcttaaaaaaaaaaaaaggccgggcacagtggctcacgcctctaatcccagcactttgggaggacaaggcaggtggatcacgaggtcaggagattgagatcatcctggctaacacgatgaaaccccgtctctactaaaaatacaaaaaattagccgggcctggtggcaggcacctgtagtaccagctacttgggaggctgaggcaggagaatgacgtgaacctgggaggcggagctggaagtgagccaagatcgtgccactgcactccagcctgggcgacaaagcgaaactccatctcagaaaaaaaaaaaaaaaagtaagaaaagaaaaaaagaaatgtaaaatagtaaacagaaatatctcccagctcttaaaattaggcaattctgttggaaaggacataactctgaatagaggttataaggaagagtttggatttaacaggagagtgccaagaagctcttccagtttacaaagcaggagagtatcattaagcctgtgttttagaagatgactgcattctgtgattctgaaatagctatatataggttgctcgtgaaatctgtgctgctagtcttcttttttttttttttgagacagaatcttgctctgtcccccaagctggagtgcagtggcacgatctcagctcactgcaacctccgcttcctgggttcaagcaattctcctgtcttggtctcctgagtagctgggattacaggagtgcaccaccacgcccagctaatttttgtatttttaatagagaaagggtttccctgtgttgaccaggctggtcttaaactcctgacctcaggtgatctgcccgcctcggccttccaaagtgctgggattacaggcgtgagccactgtgcccggcgtcgctagtcttctcttactgaagtgaaactcacctctattctttttttttttctttttctgtttttgagacagagtctcagtctgtcacccaggctggagtgcagtagctcgatctcggctcactgcagccttcacctcctgggttcaagtgattctcctgcctcagcctcccaagtagctgggattataggagtgcatcaccacgcccagataattttttttttgtatttttagtacaggtggggtttcaccatgttggccaggctggttttgaactcctgacctcaaatgatccaccggcctcggcctcccaaagtgctgggattacaggtgtgagccatagtacccagccagaaataaatttattgactgatataaattaaaattcctgtgtatagctggcttcaggaaagcctgaataggtgttcaaagaatgtcatcaggaacttgtctcaccaatcccttacctgtgttagcttcaattaaaaaaacatatttttgggccgggcgcagtggctcacacctgtaatcctagcactttaggaggccgaggtgggtggatcacctgagatcaggagtttgagaccagcctggccaacatgatgaaaccgtctctactaaaaacataaaaattatcgggcgtggtggtgcataaccgggcatggtggtgcatgcctgtaatctcagctactcgggaagccgagggagaattgcttgcatctgggaggcagaggttgcagtgagctgagatcgcaacattgcattccagcctgggcaacaagagtgagactccatctcaaaaaaaaaccaaaaaacaaaaacaaaaaacatttttttaagagacagtttcactctgtcgcccagagctgggtccagtagtgcaatcacagctcactctaacctcaaagtcctggactcaggcattcctcctgtcccagcctcccgagtcactgagactataggcaagcaccagcacgcctggttactttttttttttgaaacagggtctccctctgttgcctatggtggtatgcagtggtgcaatcatggttcattagagcctcaatctccgaggctcgagcaattttcccgtgtcagcctccaaagtagttgggactacaggtaagtgccacaatgtccagctaatttttttttctttttattgagacggagtctcgctctgttgcccaggctggagtgcagtggtgcaatctcggctacaacctccgcctcccgggttcaagcgattctcctgccttagcctccgaagtagctgggactacatgcgcgtgccaccacgcccggctaattttttgtatttttattagagacggggtttcaccgtgttagccaggatggtctcgatctcctgacctcatgatccacctgcctcggcctcccaaagtgctgggattacaggcatgagcctccatgcctggcctgtccagctaatttttaaattttttgttttagggatgaggtcttgctatgttgcccaggctggtcttgaaatcctggcctcaagtgattctcccctggcctcccaaagtgctgggattacagatgtgaaccactgcgcccggctgttagcttcattttcaggcagcctcttctttctgccattttgccgaccagagtcgaaagaaatctcatccctaaaagttcctgcaatggtgcttgggaagaatctcattggtctacagtaggtcataaattcttctgtaaactaatcaccatggggaagaggaggtaaggtatgttctgctcggccagggtaatagcagtgggaacagaggatggactggccaggaaataacatggtggaggcagagtatgcaagtgctcattgcttagcagtgttgggaaagaaagaggattttatctattgaatgccagccatgtgttggccactgtgctgggcaaatgcaactcattttgaaggccagacatggtgtggctcatacctgtaaccccagcactctgggaggctgaagcaggaggatcacttgaggccaggagtttgagaccatcctgggtgacacagtgagatctcatctacaaaaaatgaaaaattagctaggtccagtggctcgtgcctgtgggcccacctcctggggagactgtggcaggaggaggattgcttgagcctgggatgtcaaggctgcaatgaaccataatcacaccactgcaccccagccaaggcgacagagcaagatcctgtctcaaagaaacagacaacaactcagtctgtggaagagggggacatataaacaatgactatccaatgtaccagttacaatgattgaggtatacagcaagggccactaacacaaaacagaaaggaaagcatttgggcagtgactgtgggtcaggggagaggcagttcccagagaaggaaatcttgacttgagttttatttatttattttaatttttatatttttgagatggagtctcactctgtcacccaggctggagtacagtggtgcgatctcggctcgccgagccaccacacctcgccaggtttcaagggataagtaggatacatgaaagtttggtaggaaacaaagagtaagagatttcaggcccaggctgggcacggtggctcacacctgtaatcccagctctttgggaggctgaggcagatagcttgagttcaggagttcgagacaagcctgggcaacatggcaagaccctgtctctaaaaaatatataaattaaaaataaattcaggccaggcgcagtgactcacatctgtaatcccagcacttagggaggccaaggtgggtggatcatttgaggtcaggaggttgagaccagcctgaccaacgtgatgaaattctatctctaccaaaaaattaaaaaattagtcaggtgtgatggtgcatatctgtagtcccaggtacttgggtggctgaggcaggagaatcacttgaaccagggaggtggaggttgcagtgagccgagatggtgccactgcactccagcctgggtgacagagcaagactctgtctcaaaaataaataaataaattaattttaaaaaagagatttcaggcccatgtcaagggcaaagaacagagtcaaaaaagaaaaattgctggccagggcagggcctggtggctcatgcctataatcttagcagtttggtaggctgcggtgggagcatcacttgaggccaggagtttcagaccagcctgggcaacatagcaaatccctgtctctatttctttaaaaaaaaaaaaaaaaatctggccagaaaaaccacatccaaaccaaagacatatttagttttgctcgcacaacatttttagaaatttttgaattagttgccaacattgaaagatctagagctttcacataaaaatccatatttctactttatcttgaaaagccaagtttggctacacagggccagcatttcttcatggtgacaagtggctggcaccaccacagcccctccactccctgttctggttcacccgccctgcctcagatgctcatgttacctgcacagtcctctctagtgaatgaaagacggctgccaatcctttgtaaatttccacatcaaaagaagttggctgggtgtggtggctcacacctttaatcccggcactttgggaggcaaaggtggatggatcacctgagctcaggggtttgagaccagcctggccaatatggtgaaaccccatctgttgccaaaaagagtggtttgtttgtttgtttgtttatttgtgtatagacagggtctcactctattacccaggctggagtgcagtggtgtgatcatagctcactgcagacttgacctcttgggctcaagcgatcctcccacctcagcctcccaagcagctggaactataggcacacgccacctatagtctggctaatttttaaatatttttagagacaagggtcttactttgttgcccaggctggtcttgaactcctggccctaagtgatcctcctgccttggcctcccaaaatgctgggattagaggtgtgagccactgcacccagcccgctaactttttatattattcgttgagttaggatctctctgtgttgcccaggctagtcttgaactcctgggctcaagaaatcctcctgccttggcccctcaaagtgctgggattacaggtgtgagccaccacactggagccattatttattattattttgtttgtttgtttgttttgaaacagggttgcactttgttgcccaggttggagtacagcagtgtgatgttggctcactgcaacctctgcctccctggttcaagcaatcctcccacctcagcctcctgagtagctgggacaacaggtgcatgcccagctaattttgtatattttttgtagacacaaggttgcaccatattgcccaggcagttcttgaacttctgagctcaactgatccacccgccttggcctcccaaagtgctatgattataggtgtgagccactgcacctggccaaattgacaaccattttgttatttctcattattctgggattttgagcagaagcatcctgagaaaggaagcaaaaccttttagtctactgaaaggataggcctgtaattgtcacagaataacttctaccacattctatcagttaagcagtcatgggagctgggtgtggtggctcatgcctgtaatctcagcactttgggaggctgaggtgggcggatcgcctgaggtcaggagtttcagaccagcctggccaacatggtgaaaccccatctctactaaaaatacaaaaattagccagctgtggtggcgtgtgcctgtaaccccagctactcaggaggctgaggcacgagaatcgcttgaacccaagaggtggaggttgcagtgagctgagattgtgccactgcactccagcctgagtgatggaacaagactctgtttcaaataagtaagtgagtaagtaagtaagtaagtaagtaaataaataaataaaagatggatcagaagaaggtgagatggcctgcagattacttagggggttcctgcaatggtagaagcaactcaactcaggtagtgtcggtagtgatgaagagaaaaggggagattcaaggtcaagactcctcactccaggaggccctccctggggttctaatgggacatgcaggtcagaaccaggaaacacagagacaggtttgtacctcagagacaggctgagagtcatcagagtttgcaattgaagctgcctatgtggataagatagtgtggggagtttgagtgcaataagaagagatggaggtgcgggactcacgtctgtaatcccagcactttgggaggctgagatgggtgggttgcttagggccaggagtttaagaccagcctgggcaacattatgggaccccccccgcctctccaaaaaccagaagtattagccaggcatggtgttgcacgcctttagtcccagcactttgggaggctgaggcaggaggatcgcctgagcccaggactttgaggctgcagtgagctgtaattgcacccctgcactccagcctgggtgacagaacaagaccctgaatctaaataagtaactaagaggtggagtcctgggaggactctgggtgtaatgagtaaagcagaggaagagacaccccacaggggattgacagagaaagccatagagaaagatgagaacaaggggagggtgcgtcgtcgcatattcgaaaggaacatgttcaaggaggaggcatagtcagtagcattggatggacaccaaaacgtgtttgcctgatttgatgaccaggaagttactggtggccctgctgagggcaaatcttttttttttttttttttaatggagtttcgctctgtcacccaggctggagtgcaatggctcaatctcggctcactgcaacctctgtctcccgggttcaagcgattctcctgcctcagcctccccagtagctgggattacaggtgtgcgccaccacacccagctaatttttgtgtttttagtagagatggggtttcaccatgttggccagggtggtcttgaactcctgacctcaggtgatctgcctgcctcagcctcccaaagtgttgggataacaggcgtgagccaccgggcctggctggtgagggcaaatatatgtggaatggcgagggcagaagacagactcaagtaggtggaaaagtaggaaatgaggaagtggagacagtgagtgtccaccactctctcaagaaactcacatgtgaacaataggagtgaaatagggaagtggtttgaggttgccaagttgagagaggttccccctgcacacaggaacctgggtgtgttttatatcctgaaaagagagggtctgcagagagaggcctgccagtagaggagaaaagggtgaaacgatgaggtgagatcactgaagaaatgggaggaatgtgtcccaagagggatcggccttgggcccaatgagaaccattactttaaaaacatttttttagagacagggtctccttctgtcatccaggctggaatgcagtggcgcaatcatagttcactgaagcctccaactcctgggctcaagggatcctcctgcttcagcctcccgagtagttaggactacaggcacatgccatcacacgtggctaatattttattttatttatttatttatttatttgagacagagtttcgctcttgctgcccaggctggagtgcaatggtacaatctcagctcattgcaacctccgcctcccgggttcaagcaattctcctgcctcagcctcccaagtagctgggattacaggcatgcgccaccacgcctggctaattttttgtatttagtagagacagagtttcaccatgttggtcaggctgatatcgaactcctgacctcgggtgatccgcccgccttggcctcccaaagtgctgggattacaggcattagccaccgtgtccagcccatattttatattttgtagaaatggagtctcactatgttgttcaggcttgtctcaatctcctggcctcaaatgatcctcctgccttggcctccagaagtgctgggatttcaggcatgagccactgtgcccgggcaggagtgctttcagaatgtgagtcagtgctgaccctgcaggtagatggaagatcagggccacatgaggaggtgccaggctaccagagcaacctcttgccaatgaaactgttacttctttacctggagacttgtgggggctccgtgctactcactggagaaaactccttgagaaggctctgtttgaggtcccccatgctctgcccctatggaccttcccagcattctgacctttcctctcaccccaagcatctgaggccccagccttgggggacagctctccattccctaaaacgtcatgatcttttcctgccttcatctgaatggctcttctccctcctgcctctcttctttgcttggcagactcctattcaatacctagttcaggccaggagcagtggctcacgcctgtaatcccagcactctgggaggtgaggcaggcggatcacctgaggtcaggagtttgagaccagcctgggcagtatagcaagaccccatctctaaaaaaatagaaaaattagacaggtgtggtggcttgcacctggaatcccaacactttggggtgcccaggcgggcggatcacctgaggtccggagttcgagaccagcctggccaacatggtgaaacctgtctctacaaaaaatagaaaaattagacaggtgtggtggctcacacctggagtcccagcactttgagaggccgaggcatgcagatcactctgaggtcaggagttcaagaccagctcagccaacatggcaaaaccccatctctactaaaaatacaaaaattagctgggcatggtggcaggcacctataatcccagctactctggaggtggaggcaggagaattgcttgaacctgcggggaggaggttgcagtgagccgagatcgtgccactgcactccagactgggcgaaacagcaaaactccatatcaaaataaagaaatcatgtctgctatggcagacccacagtcagctgcagctctgagccaactgcaggatgaagaaccattgcctaattggaaagtgtcagcatcccagaattcaaaaaagaaatctgatgaggcttttcctgcttgatatattatatggagaatttagatcttatgttggtttgcacaagttccctgcagaaaaaaaaattgctctgtgtatatctcttggaaaataagataatactatttttcctttgcaaaggcagctataacagatgtgaagactcagtgctcggtggtgcccaggctggagtgcagtggcgtggtctcggctcgctacaaccccgtctgggaagtgaggagcgtctctgcctggccacccatcgtctgggatgtggggagcccctctgcctggctgcccagtctgggaggtgaggagcgtctccgaccggccgccatcccatctaggaggtgaggagcgcctctttccggccgccatcacatctaggaagtgaggagcgtctctgcccggccgcccatcgtctgagatgtggggagaacctctgccccgccgccccgtctgggatgtgaggagcacctctgcccggccacgaccccgtctgggaggtgaggagcatctctgccccgccgccccgtctgagaagtgaggagaccctctgcccggcaaccaccccgtctgagaagtgaggagaccctccacccggcagccgccccgtctgagaaatgaggagcctctccgcccagcagccaccccgtctgggaagtgaggagcgtctccgcccggcagccaccccgtccgggagggaggtggggggggtcagccccccgccaggccagcagccccatccgggagggaggtgggggggtcagccccacgccccgccagccgccccgtcagggagggaggtgggggggtcagccccccgccaggccagccgccccgtccgggagggaggtcggggcgtcagcctcccgcctggccagccgccccgtccgggaggtgaggggcgcctctgcctggtcacccctactgggaagtgaggagcccctctgcccggccagcggccccgtccgggagggaggtgggggggtcagccccccacccggccagccgccccgtccgggagggaggtgggggggggtcagccccccgcccggccagcggccccgtccgggagggaggtggggggggtcagccccccgcccggccagccgcccggtccgggagggaggtggggggggtcagccccccgcccggccagccgccccgtcccggagggaggtgggggggtcagccccccgcccggccagccgccccgtccgggagggaggtaggcgggtcagccccccgcccggccagccgccccgtcagggagggaggtggggggttcagccccccgccaggccagccgcccggtccgggagggaggtcggggcgtcagccccccgctcggccagccgccccgtccgggaggtgaggggcgcctctgcccggccgcccctactgggaagtggggagcccctctgccaggccagccgccccgtccgggagggaggtggcggggtcagccccccgcccggccagccgccccgtccgggagggaggtgggggggtcagccccccgcccggccagccgccccgtccgggaggtgacgggcgcctctgcccggccgcccctactgggaagtaaggagcccctctgccaggccagccgccccgtccgggagggaggtggcggggtcagccccccgcccggccagccgccccgtccgggagggaggtgggggggtcagccccccgcccggccagccgccccgtctgggaggtgaggggcgcctctgcctggccacccctactgggaagtgaggagcccctctgccaggccagccgccccatccgggagggaggtgggggggtcggccccccgccgggccagccgccccgtccgggagggaggtgggggggtcagccccccgcccggccagccgccccgtccgggaggtgacgggcgcctctgcccggccgcccctactgggaagtaaggagcccctctgccaggccagccgccccgtccgggagggaggtggcggggtcagccccccgcccggccagccgccccgtccgggagggaggttggggggtcagcccccgcccggccagcggccccgcccgggaggtgaggggcgcctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgtactaagaaaacttctgccttgggatcctgttgatctgtgaccttacccccaaccctgtgctctctgaaacatgtgctgtgtccactcagggttaaacggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcctatgaccctgccaaatccccctctgtgagaaacacccaagaattatcaataaaaaataaataaattaaaaaaaaaaaaaaaacagatgtgaaaataaatacactcaactctaatatgattatacagaagagcatgaatgcatttcaaatgttagatgttgctagtattatcaaatgatttatttttcttttcttttcttcttttcttttcttttttttttttttttgaaacagggtctctctgtcaccgaggctggggtgcagtgacacaatcatggcctaatgcaacctcgacctgctgagcttaagcaatcctcccacctcacccgcccccagagtggctgggactgcaggcacgtgccactgtgcccagttatttattttttccttttaaattttttgtagagacaaggtcctactacgttacccaggctggtctcaaactcctggactcaagcaatcctcccacctcggccttccgaagtgctaggattatgggcctgagtcaccacactcagcctcaaataatttcatattgaccttttaatcattattcctctctgccaagcactgaaaagttgaatcattatactctatttctgcagtgatatagattatgaaaattcctttcgaattcattgcagcagctaacttttttgagtcattgacttcattttatattttaaaaattatgaaataccgtctgtcattgcattctaattaaaatttgtgcagaatgctttgggaaaatggatcttttatagaaaaaaaactggaacaaatgatttcttttctttcttttttttgttttttgagatggggtcttgctctgttgcccaggctggagtgcagtggcatgatctcggctcactgcaacctccgcctcccgtgttcaagcaattctctgcttcagcctccacagtagctaggactacaggtgcccactaccatacccggctaatttttgtatttttagtagagatggggtttcaccatattagccaagctggtcttgaactcctgaccttttgatccacccaccttggcctcccaaagtgctgagattacaggcgtgagccaccacgctcggcctgggacaaatgatttctatggctttcaaagataaaatatataatatactaaatcaggggtgtccaatcttttggcttccccggaccacattggaagaagaattgtcttgggccacacataaaatatactaacgatagctaatgggctaaaaaaaaaaaatcacaaaaaaatctcataatgttttaagtttaccaatttgtgttggtctgcattcaaagccatcctggatcatcctggggttgcacaagcttgcactaaaccaactctaacatagcttattctgttttactgttaaattatatctctgggctgggcaaggtggcgcatgcctgtaatcccagcactttggaaggccaaggtgggcagatcacttgaggccaggagtttgagaccagcctggacaacatggcgaaaccccatctctactaaaaatagaaaaattggctgggcacggtggctcatgcctgtaatcccagcactctgggaggccgaggcaggcagatcatgaagtcaggagttcaagaccagcctggtcaacatggtgaaaccccatctctactaaaaatacaaaaaattagccaggtgtgggccggttgcggtggctcacacctgtaatcccagcactttgggaggccgaggcaggaggatcacaaggtcaggagatcgagaccaacctggctaacacggtgaaaccccgtgtctactaaaaatacaaaaaattagctgggtgcggtggtgggtgcctgtagtcccagctactcgggaggctgaggcaggagaatggcgtgaacctgaaagacggagcttgcagtgatcacaccactgcactccagcctgggcgacagagcgagactctgtctcaaaaaaaaaaaaaaaaaaaattagctgggtgtggtggcacacacctgtaatcccagctactccggaggctgaggcaggagaattgtttgaacccagaaggcggaggctgcagttagctgagatcatgccactgcactccagactgggcgatagagcaagactctgttttgaaaaaaaataaattagccaggagggttggtgcactcctatagtccctgctacgtgggaggctgaggcatgagaattgcttgaacccaggaagtggaggctgtagcaaactgagattgtgccactgcactccagcctgggcaacagagcgacaacccgtctgcgaaaaaaaaaaaaaaaaaaaagcttttatggatgattaaattttagtacatttccaaaaaaaaaattcttgctaaatttaggtgtaattaattatgtattacgtaatggtactgtggttaggtaaagtaatccttatctgacatacaataatatgacgaatctcaaaacattatgaaaagtgaaaaaaagcagacccgtattgtatatttcatttgtgtggaacattctagaacaggcaaaattaatctataatgacagcaaaaagatcaatcgctgtctggggctgaggttggggattgattggggaaggaacttattttttttatttttattttttttgagatggagtctcgctctgtcgcccaggctggaatgcagtggcgcgatcttggctcactgcaacgtccgcctcctgggttcaagcgattctcctgcctcagcctcctgagtagctgggaccacaggtacttgccaccacgcccggctaattttttgtatttttagtagagatggggtttcaccgtgttggccagaatagtctcaatctcctgactggcagccactgcgcctggcgagtggaaggaaattttaagggtgatgggagtatttcatattttgattatggtagtaattacatgggtatgtatatttgtcaaaactaactgaatcatgcacttaaaatgaatgtgctttattgtatgaaaattaaagtgggctgcgcgcagaggctcacgcctgtaatcctagcactttgggagcctgaggcgggtggatcacgaggtcaggagtttgagaccagtgtggccacatagtgaaaccctgtctcaactaaaaatacaaaaaattagccggctgtggtggtgtgcacctgtaatcctagctacgtgggaggctgaggtaggagaatcacgtgaacccgggaggcggaggtttcagtaagctgagatcgcactactgcactccagcctgggtgacagcgtgagactccgtctcaaaaaaaaaaaaaaaaaaaaaaaaaaagataaaaaaagaaaattaaagtgtgttttgttgtatgtaaataaagtttgttttaaaaagaaggaaaataacgttacaactagaataaaaataatccgccaggcatggtggtgcacacctgtaatcctagcactttgggaggccaaggtgggaggatcgcttgagcccaggaattcaagaccagtcttggcaaaatggtgaaaccctgtctctacagaaaatgcaaaaattagccagttgtggtgatgagcacctgtcccagctacttgggaggctgaggcaggagacttgcttgaacccaggaggaagaggttgcagtgagctgagatctcgtcactgcactggaattacaggcacacgccaccacgtccagctaatttttgtatttttgtagagacgggtttttgtgatgttggccaggctggtctcaaacttctgacctcaggtgatctgcccaccttgaccctgaaaagtgctgggattacaggtttgagccactgcatctggccagatctaagagatttttttttaagtctctgtgtgttagaggtaaatactgaagttttttttttttgtttttttgagatggagtctcactgtgtcgccagtctggagtgcagtggcatgatcttagctcactgcaacctccacctcctgtgttcaggcgattctcctgcctcagcctcccgagtagctgagactacaggtgtgcaccaccacgcccagctaatttttctgtttttagtagagatggggtttcaccatgttggccaggatggtctcaatctcttgacctagtgatctgcccacctcagcctcccaaagtgctgggattacaggtgtgagccactgtgcctggctaatactgaagtatttaagttgaaatgctatgatgtctgagatttgttttaatacattctgtttttttttgttttgttttgttttgagacggagtctcaatctgtcgcccaggctggagtgcagtggcgcaatctcagctcactgcaagctctgcctcccgagttcacgccattctcctgcctcagcctcccgagaagctgggactacaggcgcccaccacctcgcctggctaattttttgtatttttagtagaaacagggtttcaccatgttagccaggacggtctcgatctcctgaccttgtgatccgcccgcctcagcctcccaaagtgctgggattacaggcgtgagccactgcgcccggctgttttaatacactctaagaaaataatgtgaaaaaagaaatgaatcaatgtttgctaatattgccatatttgaatcaaatattgccaatatatgttgaccattgtcaaagctggatgatgggtacaaaagagtttattatacaattattcccgttttctgtatttgaaaatgtctacaggccgggcatggtggcacatgcctgtaatcccagcactttgggagcctgaggcaggaggatcacttgaggtcaggagttggagaccagcctggccaacatggtgaaaccccatcactactacagatacaaaattagctgggtgtggtggtgcatgcctgtaattccagctactcaggaggctgaggcaggagaatcatttgaacccaggaggtgaaggttgcagtaagctgagattgcagcattgcactccagactgggcaacagaatgagactctgtctcaaaaaaaattggctgcatgaggtggctcatgccagtagtcccggcactttaggagcccaaggtagaggattgcttgagcctaggaggtcgagtccacagtgagctctaatcgagccactgcactccagcctgggtgatagagtgagaccctgattcaaaaaataaaaataaagttaacaaattcttgaaaacagataaaataggctgggcgcagtggctcacgcctgtaatcctagcattttgggaggccagggcaggcagatcacctgaggtcaggagtttgagaccagcctggccaacatggtgaagccccatctccactaaaaatagaaacaaattagctgggcatggtggtgaacatctgtaatcccagctactcaggaggctgaggcaggagagtcgcctcaacctgggaggcagaggttggagtgaaccaagattgtgccattgcactcctgcctgaacaacagagtgaaactccatctcaaaaataataataataataataataagagataaatccttattaccatcaaaagttaaaaaagaagaaagaagggccgggagcagtggctcacgcctgtaatcccagcattttgggaggccgaggcggacggatcatgaggtcaggagatcaagaccatcctggctaacagggtgaaaccccgtctctactaaaaatacaaaaaaattagccgggtatggtggcgagcacctgtagtcccagctacttgggaggctgaggcaggagaatggcgtgaacccaggaggtggagcttgcagtgagctgagatggcaccactgcactccagcctgggcaacagagcgagactctgtctcaaaaaaaaaaaagaagaagaagaagaaggaaacctagttcaaattttgataaggaaaaaaaaaaagagagaatttgttgcttcacataatggaaaggatctagcttcaagtgcggctggacccagggcgggctccgggagtctgtcttgttctctccctttcttgaccctactgtcctctaggttggttctgttctcaggcagttttgcttcagatgaaggtgggatgactaccagcatttcttagacttctatcctataatgtgagtcatccaacagaaagttccaataaaaggcctgcaattagcactttgggaggccgaggtgggcggatcacctgaggtcaggagtcccaaaccagcctgaccaacatggtgaaaccccgtctctactaaaaaaatatggaagtagccaggcttggtggtgcatgcctgtaatcccagctcctcaggaggctgaggcaaggagaatcgcttgaacctggaaggtggaagttgcagtgagccgtgattgcgccattgcactccagcctgagcaacaagagcaaaactctgtctcaaaaaaaaaaaaaaaaaaaaaggcctggaattagttcgcagggcactgttggcctggcctgggtctccagcgctcatcactcctctcttaatcagctgttctctaatggcaggagtgtgctaattagcctctgaatccccagcacaaagcaccctgcctgggacacaagtaggtgggtggatggatggacagatgggtgaggaagaggatagaaaataagcaacacagtgagaccatgtctctaaaaaaattaaaagagggctgggtgaggtggctcaggcctataatcccagcactttgggaaaagctgaagcgggagaattgcttgcattcaggagttcaagaccaacctgggcaataatgcaaaacccccatctccacaaaaaatttaaaaattagctgggtattatggcacttgcctgtagtcccagtgactcgagaggctgaggtgggaggatcgctcacttgagcctgggaggtggaggctgcagtgagctgtgattgtgccactgcacgccagcctgggcgacagagtgagacgctgtctcaaaaataaattaattaaattaaataaaaaataagaaaaagagctgggcacggtggctcacgcctgtaatttcagcactttggtaggccaagatgagcagatcgcctgaggtcaggagtttgagaccagcctggacaacatggtgaaatcccatgtctactaaaaattcaaaaaatttggccgggcgtggtggctcacgcctgtaatcccagcactttgggaggccgaggcgggtggatcatgaggtcaggagatcgagaccatcttggctaacacagtgaaaccccgtctctactaaaaatacaaaaaattagccgggagcggtggcaggctcctgtagtcccagctacttgagaggctgaggcaggagaatggcgtgaacccaggaggcggagcttgcagtgagccgagatcgcgccactgcactccagcctgggcgacagagccagacgctgtctcaaaaaaaaaaaaaaaaaaaaaaaaaaaaaaattcaaaaaattagccgggcgtggtggcgggcacctgtaatccctgctacttgggagcctgaggcaggagaatcgcttgaacctgggaggtggaggttgcagtgagccaaggtcgggttactgcactccagcctgggcgacagtgtaagactctgtctcaaaaaaaataaaaaataaaaaataagaaaaataagaaaagggtccctttcacatgtttacaaagcatgctaccatgctaagggcagaaactccaagtggaagtgacttcccaaagacagcatgttacgtgtgtcattctagggccacactttctccatggagaaggcggagggggtagggaaagttgccagcacactccagcctggttcctggcactgtgcccagcatttatagctagtttccattagtcctcatcctctataaagtgagggccactgtgcacctgtcctagatgaggaaaacgcacctggccagggacagtaaggagatgctgaaaccaaggttatcaggggtgcctgaccccaccatgctccacagcctcctttgggcaagacagactagggaagctctgtgaaccttgctaaagacattggactttggccgggcatggtggttcacgcttgtaatcccagcactttgggaggcccaggtgggtagatcacctgaggtcagaagttcaagaccagcctggccaacatggtgaaaccccctctctactaaaaatacaaaaatttgccaggcaaggtggcatgcaccgtaatcccagctactcgggaggctgagtcaggagaatcgcttgaacctaggaggcgcaggtcacagtgagcagagattgtaccactgtactcaagcctgggtgacagtgagactctgtctcaaaaaaaaaaaaaataaataaataataaaaataaaaagaggagtaatgatttgattccaacacttcagtctacctctactgtaggtatctggctccttggaagggcctctggtcctgtctccctccagggtaggtgtaatcagaactttttcagctgcaagtgccaggaatccaactcatacttcttggcttacgtgaaaaagaagtgcattgccttatacaacaggaaagttaagggtttcaggcacagcttgatccagacactcaaatgatctcaagaatatgtctcttcatatctggcctcttcaggcctctgtgtagacccatcctagccagctttttgctgttttttttgtttttgttttttgtttttttttttttgagacagagtcttgctctgtcgtccaggctggcgtgatctcgggttaccaaaactcccacctcctcagttcaaactattctcctgcctcagcttcccaagcaactgagactacaggtgcacaccaccatgcctggctactttttatatttttagtggagacaggttttgccatgttggccaggctggtctcaaactcctggcctcaggtgatctgcctgcctcggcctcccaaagtgctgggattacaggcgtgagccactgcaccttgctctgaccagcttttcctgcataccaacaagatatcaccagcagtgctgggcttacatcctatcagcttcctaactcccagtggagagagggcatctttttcacagcagctccaaggtgagtcttgggcacaagatgaatcaagtgcccatccctgagccaatgaaaacaggttgctttggttgggaagcacaggccatgtgaatacgccaggtcccctcctgaacctcatggagtgcctgtgaggagaggttggttccccaaaagaaaatccaataaagaggcgacgggaccaggcacggtggctcatgcctgtaattgcaccactttgggaggctgaggcaggaggattgcttgagcccaggaggtcgagacccacctaggccacatagtgagatcccgtctctaccaacaatttaaaaaattagctaggtgtgttgggcatgtgcctctggtcccaggtactcgggaggctctgaggatggatgggaggatcgcttgagcgtgggaggttgaggctgcagtgagctgtgatcgtgccattgcaccccagccagagggagaccctgtctcaaaaaaaaaaaaaaaaaaaaaaagagagaggcaatggtaagagctaaaccagcaggaacaagagaggcaaaggtcccccttttttttcttttaattgaaactgggtctccctctgtcacccaggctggagtgcagtggtgcaatcatagctcactgttagcctggaactcctgggctcaagcgaacctcccacttcagcctcctaagcagctgagaacacaggcacatgccaccacagctggctaatttcattttttttttttttaagagatggggtcttgctatgctgcccacactggtctcaaactcctaggctcaagtgattctcgccgctcctgggcaaatgccctctgacatcccttataaggacaccctttgaaaaggttgtccccctctcaaacatggagagccttgccagggccttccccactcactgctgtaactaattcttatgctgcatggacatctgcttcccagaacctccacccaccagccttgcccctgacctttgtggcagccccaaggctgcccaccccttcccctgctgcagcccacttggcctctgaaagcagcactgtctgcctgcaccttgccctctccagggccgtcaggctcgccaccttcaggagcctagttttcaggtccttcaccaatgccctcgtcctgtgggtggacatgaggccctccagagctgaaggcagtgtgtgcttcagtttctgcatctgtaaaatggagatagtatttgctacccaggggtgctatgaggattacatgaacatagtatagtgtctagaacagtgcccagcacatagtaggcactcaataaaagccagttattattcctgtcacttctgtgggagacggcacatcagagtacccaccttatctcggtctagtcccgtccagtcgcaggcctttgagtacagtacagccctaaggtttttacaattgaataatctataaaagatttacagatttattgtctcatttgagcctagtaacttttttgttgttgttgagatggagtcttactctgttgcccaggctggagtgcaatggcacagtcttggctcactgcaacctctgcctcctgggttcaggcgattcttctgcctcagcctcccgagtagctgggactacaggcgcacaccaccatgcccagctaatttttttttttttgagacggagtttcactcttgttgcccaggctggagtgcaatagtgccatctcagctcactgcaacctccgcctcccaggttcaagcaattctcctgcctcagcctccagagtagttgggattacaagcatgcaccaccatgcccgggtaatttttttttttttttttttttgagatggagtctcgctctgtcacccaggctggagtgtagtgccacgatctcggctcactgcaacctccgcctcctgggttcacaccattctcctgcctcagcctcccaagtagctgggactacaggcgcctgccaccatgcctggctaattttttgtatttttagtagagagggggtttcaccatgttagccaggatggtctccatctcctgacctcgtgatctgcccgccttggcctcccaaagtgctgggattacaggcgtgaggcactgcgcccggccagagcctcataactttgtgaggtgggcagttcaaatcttattaattccccatttaccaatgacaaaatgaggttcagagagattagccctcttggccaagatcgcacagccagtcagtggcagaggtgggacttgaacccgtcccttgctgttccttgaacttctccacacgacagggctgtccctcagcctacaggtcacccctctagccttgcctgttggctcttcctaatcctttcaggcccagcccagatactttttaaacaagaatgatgagagctaactttttttaaaatgagacggtcttgctctttcacccagagaagactgggtgataacagtggctcaatcttggctcactgcagcctctgcctccagggttcaagctattctcatgccttagcctcctcagtagctgggattacaggggtgcatcactacaccacgctaatttttgtatttttagtagagatgcggttttaccatgttggccaggctggtctcgaactcctgacctcaggtgatccgccagccttggcctcccaaagtgctgggattacaggcgtgagtcactacgcatggctgagagctaacgtttattaagcacccgccactttctagatgaggtccttactgacttccttgggttattttaggtaatcatccccatacctcttacgtggcaggtatgactgttacagagggagaaaccgaggctgagaaaggctaagtagcggccacacctcactcagcaggtgacaggctgcggtcgcactcatgacatagtctgactctagagcaggcctttcctgcccgctgttgctgcctccagaagcctctctgaatccaagggtgggaactattcctccttgccctcgagccttcgccaaagccagggcttggagcggccgtgggctcctcctccttcccccaggctgggctcttcaggggcggaaacctgcctggcttgcctgccttgctcgaccctgtagcccctggcacgaagtaggtgcccgtgatgccggattatttcagcaggagggcaggggtgttcccgatgaagccaggagatccagggaggagaagcgactcccggggccacccatgcttagatctcagagccaggcaagagccaggtcccgggggtccaggagcgcgctcggggctcctcctcgcccgcgccccccgcgcccctcgcgccccccgcgccccccgcgccccctgcgctcgcgtctgcggggccgggaggaaggggcggcgcagccgggccggggcgggcaccgaggcctggcgggcgggcctggggcgctttcgtgcctgccagggaaaggctggcgaggaggctgggggcggacgcagggaggaaagaagcaatggggtgctcttgcgttttgacattttaaaaagaagtttagattcgcttcccggagccgggatggcagcctgcgctatggttggggaccaacgtggtgcacgggcaggggccggggagagaggcggccgcagcgggagcccgggagcgcagggcgggcctggaagagctccgccccaaggggcgcggccaccccggaggcgggcgcacggctgcttctcattcattgtcttgacaagagcatcttcagcgggcgagtccccggctcctccagctccttcctcctcttcctcctcctcctccacctccggcttttgggggatcactgtcctctctcggcagcaggtgaggctgggcctgggaggcgcgggtgggccggggcgagggccacctgtggggcggcgcgcgcgtgggagccgcgggctgcgggggcgcgcggctgtcaccgcgacccagccagcgccggggccaggtagcgggcgcagcagcccgtggggggacgctgcttggagtgggggccgccggggccccagagcgctctgcggaggcgagggctagggaccaccgcggccaagatggaggtgggtggccgggggtcagcacagtgtcgagggcccgactccccacggaattgagtctcggggagggtggggacgagggcagggtggggtgagcggggcagctgccctgggcttggagacaggaaggggttgagagcaaaacaagaaaagaccaagttcccctttccgtggtttccgggcctggtacctgtggtgggggaggaggcagggtggggcgatggcttcctgtcccccacctctggtccggggctcccctctctccagatacaggctgctcctcaagactggggctcttcacatacgctcctcaccgctctttgggcaggccgacctagcagcctcttcgggagtcctggggtggccgggggtgctggagcccccagtgagtaggcgaggctgaggctaggggcagaggctctgggcatggcaccctccaagcggcagcacaggccccttccctgagcaggaaggtgatgcggtggcacaaggtcgcccctggagttccttgctccccacccagacactgggggaaaccatcctacctggacctcagagcagtcggagtggcctctcccttcctgtgtgcagtttacatgggggtggagatggctcttaagggcacctgcttttctgagcggaggcgagaggcagaggtatggggaggaggagatacctggacctgagccagagacctgctggggaagctatcctgccgcctcactcccctcaggcagcccccacgccacttcctcctgtgtccagccccatgccagcaggcgagggaggccagctcctgtccctgcctttaggaagcgctgtgtgggtgtgagggaggtgggctctggacacggtaactaagagagaacccaccctcggagccatctgggctgatgacgcctgagtctgaaccattaggaaggacgggctctgcatccatcagccagtcagtcaacaaacatgcagtggggcaacaccacgccaggctctgttgcagaggctgagggtacagattgagagggtggctcagagtggcctggggccagggagaagggggcttgcaggttagagggaaggagaggctggggaaggcaagcaggcatcagccacagagggaagaatagggagcccctggagatgatgctgggaccttaaaagccagactgaggggtgtcctgggggaggtggggaccactggaagatcagagttgacctgaagggagaaatgctcttatgctgtgtgcccccagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaaggtgagcccctggggccctggggggagcagctcctccaccggacccatggctctgtgcaggtcctgattaggtgacggtcaccaggccttccagggcctgtgttgccatctggaaaactgagctgggccccatgagccttacacttcctccagctcctctgtgctgtggctgtgtggaaactgacgctcagaaggagccaacacaagatgggtcacaccagtgaccaggactacagacagtcctgcagacccatgatcagccctcctgagcctcagcctggggctttctccccatggaaacacagagggggttgggatggggtctgggggccctggcagcgttctcagggttgggagggactctggctctgggcctgtctgaggacctagcaactctgtcccccagctcgcaggcagggatgatgcaagaggtgctctcccccacccgcagccctgccctcccctggagcctgctgccccctccgctggctggctgctgccccgcacccccagcacactcctgtgctctttggggggtaagacaggaaggggagatgggccccaagttgttaccttaaaagggctgatggaagcaaagagaagaggaagtggttgtcggggtgagagctgggcccgcgccccacatggctgtcacacaggaagccctgctgaagcagctgtccccggaagaagccatttccaaacctctgctcctgcctggggccagttgggacaggctccctggcccctctccttttgggaggacccacccctgcagccccaccactcacactcgctctctggggagctgcctccacccccccagcccccatacacctgtcctggctccagggccagttgtgcccatggaagcctcactcggggaagctggggtgggggtgccaaccctaagggcagagacagactgagacagagaccggcgggaactctgccagggtcttgcacggcccccaacctctgccatgcgtggccagccctcctggggtttgcccaggccattttgggactggaacaagagaagaacaacccgcccccgtccccaccccaggccctggtccagctcccagggacaccacagctttcctctctgggcctctctgaaggaggtgtggggaggttggattgggtttgggaggcaaaagcacctccaaggccctgctgtgcctttagactggacgtgtggacaagaatgcgcccacggtctgtggccacacagcccctgtgctagacatcgcctggtgcccgcacaatgacaacgtcattgccagtggctccgaggactgcacagtcatggtgagtggtggtggggacccaggggctgggagaggggctctaggatgggatctgacatttggagtcctgaagactcactggcccctcctctgcaggtgtgggagatcccagatgggggcctgatgctgcccctgcgggagcccgtcgtcaccctggagggccacaccaagcgtgtgggcattgtggcctggcacaccacagcccagaacgtgctgctcagtgcaggtgctgcgggaggaggggcttgggggtggctcgtggcctgcagtggatgagggcaggaggctcatggcttctgacactgtggggaacgtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgtgagtcgccatctaccctgacctttgaccctacagcctttatccttcttatccaccatcagccaggcccttggatgctgccctccctcgcctccacctgggactggccccgtagggtatgtacgggtgcctgacctaccacctccctttccttgcaggagaaggaccgtccccacgaggggacccggcccgtgcgtgcagtgttcgtgtcggaggggaagatcctgaccacgggcttcagccgcatgagtgagcggcaggtggcgctgtgggacacagtgagtgctggggcaggaagccgagggcccccaggctgggaaccaagactggaggtttcgtccctgctctgccactcacctggcaggatggccatgggcctcagtttacccaggcgtgagatggttgttcccactggttggtcgggagggccctcacaggtcactgcccagggaagaccaccatcccagggcctgggatgttacctctcacctgtgtctacagaagcacctggaggagccgctgtccctgcaggagctggacaccagcagcggtgtcctgctgcccttctttgaccctgacaccaacatcgtctacctctgtggcaaggtggcctcgtcgggcggggtgggggtgggaggtgggcaggatgggcctggagagggccagggcagtgggcatccgctggtattgaccctccctccacacctgccacctacagggtgacagctcaatccggtactttgagatcacttccgaggcccct

SEQ ID NO: 491 - DNA, 539060 bp, Homo sapiens
taaactctgtgcgtaatttcactattttcttgtttaactttatgactgtcctggagagggcagcatcattacctttaatttagagctgggacagggacagtctgtgacacttatcttgatattgaggaatggagtcagtcctccaatggagggaggccgattgaggtgtgatactgagtgccccatcagttgttcaagggctggggcagatctaatattgtgtctgtactggctgatacttaggtggccagggccccagctttggaaacctgtgatggctgctaccacctctggctttgctaggcgcacacatctgcccagactcaatgtattgcaaacccatgcaacctccaggcccacactgagaatcaagaattgtggactcttgattctccaaatcttctcaaaagcccagctgctggctgggtacagtggctcacatctgtaatcccagcactttgggaggacgaggcgggcggatcacttgaggttaggagttcaagatcagcatggccaatgtggtgaaaccccatgtctactaaaaatacaaaaattacctgggcatggtggcaggcacctgtagttccagctacttgggaggctgaggcaggagaatcgcttgaacccgggagacggaggttgcagtgagccgagatcgtaccactgcactccagccttggtgacagggcgagactctctctcaaggcttgagggctgagtgaacactccttaactatttccagttatagccacgggtcgacttagatcaacagaagtctgtatggattactctaatagagtgcaaaaagatctgaactaggacctcattgtgaattcggatcctaccccttaccagctgtgtgaccgtgggcaagacacagaatctctgagctgtcactgccctctctgtaagtgaagtggcacccacttcttatgtctgtgttggtcctcttctcctaattgacactcactcgtttttcgttgttttttttttgagacggagtgtcgctctgtcgcccagactggagtgcagtggcacgatcttggctcactgcaagctccgcctcctgggttcatgcaattctcctgcctcagcctcctgagtagctgggactacaggcgctcgccaccacgcctggctaatttttcgtatttttagtagagacggggtttcaccgtgttagccaggatggtctcgatctcccgacctcgtgatctgcccgcctcagcctcccaaagtgctgggattacaggcgtgagccatggcgcctggccactcttttttttttttttttttttaactttgagatagaatcttgttctgtcacccaggttgaagtgcagtggcataatcctatctcactccaaactcaaactcctgggttacagcaatcctcccacttcagcctcccaagtagctgggaccacaggcacatgcccccctgcctggctaatttttaaaattttaagtagagatagggtctcaccgtgttgcctaggctggtctcaaactcctgggctcaagtgatcctcccaccttggcctccaaaagtgttagggttacaggcatgagccatggtgcctggtgacactcactcttgagttgagctcacacagacccctggctttaaatatcatccaaatgttgatgtcccccaagttttcatcttcactgcagacctcttctgtgagcttcagaactgctcacttgaaacttccccttgggtgtctgacaggcaacacaaacttaacatgtcccaacatgaactttttttttttgagacagaatcttgctctgttgcccaggctggagtgcagtggcctgatcttggctcactgcaaactccgcctcccaggttcaagtgattctcctgcctcagcctcccgagtagctgagattacaggcacgtgccaccacacccggcaaattttttgtatttttagtacagacagggtttcaccctgttggccaagctggtttcaaactcctgagctcaagcgatctgcctgcctctgcctcccaaagtggtaggattacaagtgtgagccaccgtgcccgggcccaaaatgaactctttatcttctcccccatacctgctcctcctgcagccttcccatatcagaatacaacaattctattcttacagttggtgtggccgaaaaccttggtgttgtcctcaatcctctctcacacatccccaaatccaatctgtcaagaaaccctggtgatcacttgagcccaggagtttgagaccaacctgggcagcatagcaagaccctgtctctacaaaaaatacaaaaatcagcggcagggcgcagtggcttacgcctgtaatcccagcactttgggaggctgaggcaggcagatcacaaggtcaagagatcaagacaatcctggccaacatggtgaaaccccgtctctactaaaaatacaaaaattagctgggcatggtggcacgtgcctgtagtctcagctacttgggaggctgaagcaggagaattgcttgaaccagggaggcagaggttgcagtgagccaagatcgtgccactaccctccagcctggtgacagagcaagactctgtatcaaaaaaaaaaaaaaaaaaaaaaaaaaaagctgggcatgatggcacacacctgtggtcccagccactcaggaggctaaggtgggagggtcgcttcagcccagaagttggaggccgcagtgagccataattgcaccagtgtactccagtctgggccacagaataaaactctgtctctagaaaacagaacaaaacaaagttgaagctctctaaactctccacactgactcagagtgaaagtgctaataatgacctaaagccgtgccctatggccccctttcctcttgacttcgcttttcatgcactctgctccagccatactggcctccttgggcttcccagaacacgcgaagcaggacccaggttagggcctttgaactggctttgtttgtccgtgggattccccatgaacatctcatggctgctccctctcttccctcaagtctcccctcagatgtccccttctcagagacatcagcctgtagaaaggagcacttccttcccccactttcctgcgtgatgtttctccatgatgcctgcttcctacatatgtagagtctgtctcactccggagaaggctacctccaagaggacaggtgactggcccttgatttcattaattgtcacaatcctatgccggacacatggttggtgttcaacaaatatttgcggaattaaagaacaaattaataatgttgtgagataaatactctgtgcccatttttctttactttttaatatattttttaaatctagagagacagggtctccctatggtccccaggatggcctcaaaactcctcctgccttggcctccttggctgggattactggactactactgtgccaccatgcctggctcttcttttccttttactatgcccattttaaaggtgaggaaaactgagactcagaaatgttcccaagggcacacagtgagtggtggctgccttcaggttggtctgactccagtgcccaagcctttctcaggagtggtgtgttgcccatcagccattatatccatgacatcaactggcataagatatgttcttatatgaaaattaattttagaagtgagtgtcacgaaatattgaccttctctaaggaactagttcttatagtcaaaaaggaggaacttatgtaaattttccctttcagggccagccccaggaagttcagagcctaatgtggtgttcattctattaattttttcttaccctgggacttttttctttctttcatttatgttaacctaatcaccagctgcttcctgttccttaggaaatagctaagtcgtacatgacacttttggggttccagtgtgcccggcatgggttttctttcattgggcaggcactaggtgggcttttcagcctgaagacgcatgtttctcatcagagtgagaatgatctctgatcattctccttcttccatttcttgggttctctcttcctggcactcctattggttagcttttgggcctcttggattgcctggctgtgtctctgtggcaaagactactcattatccaaaatccaatgagcccttcttccccaagaacatggtggaactgcatgtcccagcctcccttgcagtaggcatggtcatgtgactaagtttccaccaatagaatgtgaggaggtgatgtatgtgacttctggtctttggccttaggaagtaggccagcttcatactctccattcctgctggctggagatccccacaacagattcaaacgtgcaggtgacaaacggtgccctaccgatggcagaaaagtgatgaggaagggcccttggtccctgagcaatgagagaagcagagctgcctccctaactaccaccatttcacttgaacatgtctcttcttttgtttatttatttatttgttttttgcagacacgtctcttcttttttttttttgagatagagtctcactctgtcccaggctggagtgctgtggcacaatctcggctcactgcaacctctgccttctgggttcaagtgattctcctgcttcagcctcccaagtagctgggattacaggcatgcgccaccatgcctggctaatttttgtatttttagtagagacggggttggccaggatggtctcacactactgacctcatgatccacccaccttggcctcccaaagtgctgggattacaggtgtgagcaactgcgcccggccgacacgtctcttctttaagccgccacttattggatctctatgttagagcggcagtctcatatattttctctcatattttcttctccacccctacaccttctgggagttctattttctgggataattaattaattaatcaatttttgagatggggtctcactctgtcccaggctggagtgcagtggagcgatcttggctcactgcaacctctgcctcctgggttcaagctattctcctgcctcagcttcctgtctcaaactcctgacctcgtgatccacctgccttggcctcccaaagtgctgggattacaggcgtgagccaccgcgcccagctttatttattttttaaattttttattcttgagacagagtctcactctgtcacccagggtggagtgcagtggcataatcttggctcatggcaacctccgcctcccgggttcaagcgattttcctgcctcagcctcccaagtagctgggattacagacgcctgccaccacacctggctaatttttgtatttttagtagatggggttttgctacgttggccaggctgatctcgaactcctgacctcaggtgatccgcctgccttggtctcccaaagtgctgggattacaggcatgatccaccacacctggcagttttctgggataatttattaactttttattacaacacttcctgtttgtgtttgtacagatgaggccttgctatattacccaggctggtcttgaacttctggcctcaagccattctccttggcctcccaaactgcaggaattacaggagtgagctactgtgcccagcttctttattctaatgcttttagtaattcagtatcatagctttaatttctaagaattcagtctttgctctatttatttatttatttgagatggagtctcactctgtcgcccaggctggagtgcagtggtgtgatcttggctcactgcaacctcctcctcctgggttcaagcgatcctcctgcctcagctcccagaatagctgggactacaggtgcctgccaccacacccggctaaatttttttttgtatttttagtagagacagggtttcaccttgttggtcaggctggtctcgaactcctgtccttaggtgatccacctgcctcagcctcccaaagtgctgggattacaggcgtgagccactgtgcctggcctctttcttttttataacaccctgtttttattgtaacatagtgtagcaattttttttttctttgagatggagccttgctctgtcgcccagctggagtgcagtagtggatctcggtttaactgcaacgtccgcctcccgggctcaaatgattctcctgcctcagcctcccgagtagctgggattataggcacctgccactgtgcccagctaatttttgtatttttagtagagacagcgattcaccatgttggccaggctggttcgaacccctgaccccaggtgatcagcccacctcggcctccaaaatgctgggattacaggtgtgagccactgcacctggccagcaatatcttttttttttttttttttttttttttggggaaagagtcttgctctgtcgcccaggctggagtgcagtggcgcgatctcggctcactgcaagctccgcctcctgggttcatgccattctcctgcctcagcctcccgagtagctgggactacaggcgcccgccatcacgcctggctaatttttttgtatttttagtagagacggggtttcaccatgttagccagaatggactcgatcttctgatctcatgatccacctgcctctgcctcccaaagtgctgggattacaggcgtgagccaccgtgcctggcccatctttttttttttttttaatatggggtcttgctctgtcacccaggccagagtgcagtggcatgagcacagctcactgcagcctcaaatacccaggctcaagtgatcctcccacctcagcctccagagcagctgaaattacaggcacgtgctaccacgccctgcccagctaatttttttttggaagcagcaccttcatttattagggacttcggtggggatggggaaaggcggcccccgggtcagaggcgccggaagaagagcttggagccgtggtctaacgtgcactcgctggggcccagctggctcccgcccagctctttttttttttttttttttttttttttgagatggagtctcactctgtcgcccagactggagtgcagtggcgcaatcttggctcactgcaacctctgcctcccgggtttaagcgattctcctgcctcagcctcgagtagctgggattacaggcacccgccaccacacctggataatttttgtgtttttagtagagatgaggtttcaccatgttggccaggctggtctcgaactcctgacctcaggtgatccacctgcctcggcctcccaaagtgctgggattacaggcatgagctactgtgcccagccccgcccagctaattttttaattttttgtagagacaggatctcactatgttgccagggctggtttcaaactcctggtctcaagcgatcctcccgctttggcctcccaaagtgctgggattacaggggtgagcctcgtgcctggcctgaagcagcattttctcaaatgtctttaaaaataccagatttttttttttctttttctttttttcttttcttttcttttcttttcttttctttttttttttaagacggaatctcgctctgtcgcccaggcgggagtgcaatggcgcgatctcactgcaagctcactgcaagctccgcctctcgggttcatgccattctcctgcctcagcctcctggtagctgggactacaggcgcccgccaccacgcccggctaattttttttgtatttttagtagagatggggtttcaccatgttagccagaatggactccatctcctaacctcatgatccacctgcctctgcctcccaaagtgctgggattacaggcgtgagcgatcgcacccagcctctttttctttacgtaaattctgtttcctccaggattacttttcttttctttttcttttttttttaaatttttttgaatgtacttaggatgcatttggctacaaataactaaacatccgacttacaggaagctcacagaagggggtggctgggattcagggccccttgatcaggcatttgcgatgccttgggatcccatgctcttcctcccattcctcctctgcaatcctgcaatgtttccatcctggggccagttcctctcagagttacaggatgtatccttaatcatggcttgtgggaggcagaagttactgcccccgggttctcttttaattaaaaggaagaagcctttcttagaagcctcccttccttttatcttagtggctagaactggggcatgtaccctttcctaatgcaatcgtgggcagaaggggagtggttactttagactggtcagactttgctggagctgaagaaggaaggggtcagtgcccaggatgtgtatgctggtgggcacctgaacaaactggggtacttttaggaaagaaggaggcagaatggatgatggggttggtttatcttggtgctttcctttcatgttgcagggtttctttgaatgttgttgatatttcttccaggcgtgacggctcatgcctgtaatcccagcagtttgggaggccgaggtgggtggaatctcttgcgctcaggagttccagaccagcctgggcaatatagggagacctctgtctctacaaaaattagccaggcgtagcggtgtgcacctcccagttttgctgggaggattacttgagcccaggaagttgagttgaggctgtagtgagctgtggtctcaccactgtattccagcctgggtgacagagtaaaaccctgtctcaaaaaaaaaaaaaaaaaaaaggttgatatttctttcaagtcccatcatacttcagagtgagccaataagaggctgactggggcttttggtaccagagtagagctttccaacttgagggttggactttcatatcaagtgtgagaataaactaaagacctatttaggtgcaagattactttgggcacggtggctcacgcctgtaatcccagcactttgggaggctgaggggtgacgatcacctgaggtcagtagttcgagaccagcctggccaacatggcgagaccccgtctctactaaaaatacaaaaattagccaggcatggtggcgcctgcctgtaatcccacctactagggaggctgaggcaggaggatcgcttgaacctgggaggcagagtttgcagtgagccgatattgccccactgcaccccagcctaggtgacagagtgagacaaaaaaaaaaagcaaagttcacctttttattagggagctttctttggatgtgacttgaaaatgtgctcctgcaaaattaagagggtaaatcacaaaagagaagggtgcagactacaggaaataggagatcccacccaagagagaaataaccactggtcccaagatgtagcagtgtagcaacagggagtgggaggggagaaggaaggtcacactggagcaaggaattagtgaagcaattagaaactctaggtaaaattaaaagagatgtattgtagtaaatttactatgatacattatcgtagtaaatatcgctaaaattttatatatatatataaatatatatatttatataatataactgaacaatagttatataatgctttttttttttttctgaggtggcatcttgctctgttgcccaggctggagtacaatggcacgatctcagctcactgcaacctccgcctcctgggttcaagcgatcctcctgcctcagcccccctagtagctgggattacaggcacgcgccaccatgcccagctaatttttttatttttagtagagatggggtttcaccatgttggccaggctggtctcgaactcctgacctcaggtgatccacccgcctcggcctcccaaagtgctgttattacagacgtgagccaccgtgctaggcatttttttttttttttttttagagacatggtctccctttgtcacccaggctgcagtgcagtggtatcatcatagctcactgcagtcttgaacttctgggctcaagtgattgtcccgtctcagcctcctgagtagctgtaagtacaggcatgtgctaccatgcctggctactttttttctttttttctgtacagatggcaccttgctatgttgccccagctggtcttgaactcctgacctcaagtgatcctcctgccttggcctctcaaagtgctgggattacagacatgaggcaccacatccagccccataatcttaaaaacaaagaaaattaatagttttccattttagactcaaactctggaccagacagcactgatcttgactatctgaggtgatagaaatagcctttatctgtgttatttgatttgatagctactagccacatgtggtttctgaacacacttgaaatgtaactagctagttgcaactgagggaactaggttttaaatctcattaaattttaattaagttaaagtagtctcctgtggccagtggcttctacattaggcaatgcagctctaagcaagatgaaagagagaatgccaatattatctacatttaacaacataaaagtaaatgtacaggtaacagaaatgagcagaagagagataaaggaaagccactatcttcatgtcacaaagtgataagaatttaggccagaagctgtggctcatgcctgtaatctcagtacttttggaggccgaggcaaggaggatcgcttgagcccaggaattcaagaccagcctgggcaacataatgagatccctgtctctacaaaaaaaattaaaaattagctgggcatgatggtgcacacctgtagtcccagctactcaggaggctgaggtaggattgcttgggcccaggagttcgagggtgctcatctctttaaaaataagtaaataggtcaggtgaggtggctcatgcctataatcccagcactttgagaggctaaggtggacggattgcttgagcccaggaaattgatctcagcctgggcaacagcgaaacaatgtctctacaataaatataaaaagtaaccaggtgcatgccgggcgcggtggctcacgcctataatcccagcactttgggaggccaaggcagggtggatcacaaggtcaggagatcgagaccatcctggcgaacacggtgaaaccctgtctctactaaaaatacaaaaaattagccgggcatggtggcgggtgcttgtagtcccagctactcgggaggctgaggcaggagaatggcgtgaacctgggaggcggagcttgcagtgagccgagatcgcgccactgcactccagcctgggtgacagagcgagactccgtctcaaaaaaaaaaaagtaaccaggtgcggtggcacacacctgtagttccagctacttggaggctgaggtgggaggatcactggagcccaaggttgcagtaagctgagatcaggccactgcactctagcctgggcgaaagagtgagaccctgtctcaaaacaaaacaacaacaataataaaactcatacataactacgtaaataaagttacaaaagcaactttagttcgttacaaaggacctgaagagagggatttaactgacctgcaaggtggaatggggctggagcagggccagtgggtcagacacctatgattatgccaggcaaaatggatacatgaagaaataaagttatagcatctccatgtagtaatagaaaaaaaaaaggaataacgaaattagcacactttttgggaatgtggacccaccagtagaattgagactagaaaaagttaaaagcattagaagtgttctctttctgagatcatgacttgttggggaaagggaagacttattgttcatgacaaacacttctgtgcttataacatgcattagcttaggaaacagcacttttctttttctctttttttttttttttttttttttttgagacaaggtcttgctctgtcgcccaggctggaatgcatgttgcgatctcggctcactgcaacctctgcctcctgggctcaagcgatccttccaccttggcctcccaaggcgctgggcgctgggattacaggcatgggccaccgtgcccggcctggtgcttttcagtgaataaataagtatgtaaacttctcttttctgactagacggaaattccccagaggacaagggtggcgtgacttgtcagtccttttcattgacagcgctgtggatgggaagaaagggcccctggtcccaagcaagccccagtcctgtggccctggaggatcagaagggtaattaagtgtcaaaggaaaacatagccagacatgagttactgtggtgaaaacagattttattcagtaactactcgtggtaggagaaagagctgagctccattctgatttgtgcagaggtgatttaggcatttaattagttaattagtttttgtgggacagggtctcgatctgttgcccaggcttgtgattgtgcctgttgctcagattgtgcagtggcacaatcatggctcactgcagcctcgaactcccaggctcaagtgatcctcctacctcagcctcctgagttagctgggacccacaggcgtatgccactgcacctggcttttttttttttttttttttttttttgaaacagagtctcgctctgttgcccaggctggaatgcagtggcatgatcttggctcactgcaaccaccacctcctgggttcaagcaattctcctgcctcggtctcctaagtagctgggattacaggcgcgtgccacaatacccagctagttttagtttgttttttatttatttattttttttagtagaaacgacgtttcaccatgttggccaggctggtctcgaactcctgacctcaggtgatccacccacctcggcctcccaaaatgctgggattacaggagtgagccaccgcaccagtgtctctctcttataacaccagctagtccttatcaggctttgactgtgggcccctcacctgtctaacttatccttcccaggaactttgaagaatactattattattcctattttgcaaatgaagaaactgaggcagattaaatgcctgacccaaggccatccagacggcaggcgatgcaggcaggagtcaagctcaggtacccctccccttctgtggcttccctgcctccaggcttctgccagcccctgtctaccttggtgtaggagcggcccctcaaagacctgcagggagccgggcacggtggcgcacgcctataatctcagcactttgggaggctgaggtgggcgtatcatgaaaccctgtctctactaaaaatacagaaattagccgggtgtagtggtgggcacctatgatcccagctactcagaaggctgaggcaggaggaacgcttgagaaccccagaggcggaggttgcagtgagccaagatcgagccactgcactccagcctggacgacagagcgagactccatctcaaaaaaaaaaaaaacctgtagagggaaggaggaactggggcctggggagggcagagctattatctcaggagaagcaggcaaacctctggtgacctctgatgacctcagggcaggatgggcaggccttcacaacagctccaggcacacccagcctcccgtccctggcctcatcactcccctctctgccctccaccctttggcctccttgcctttgtccacagttctgcagcctgataccctcttccttgtctcaaccagagaagtcttcagtcaataaacgtcatccaatgcctactgtgtgtcaagcacttcctgggtgctggggcactgtgcaagcacacacgcacagctgtgaggccatggggctggcattccagtgtggggagagcgacggaagcaaaataagaaagtccattacatggcgcatttgaaggcgcgaagtgctatggggagaaagcaaggaggggggttacagtccagagggaggggggtgcgattttttttttttttccagacggagtcttgctctgtcacccaggctggagtgcagtggcgtgatcttgcaaactccgccgcctgggttcacgccattcttctgcctcagcctcctgagtagctgggactgcaggcacccgccaccatgtccggctaattttttgtatttttagtatagacagggtttcaccgtgttagccaggatggtcttgatctcctgaccttgtgatccacctgcctcagcctcccaaagtgctgggattacaggcatgagccaccgcgcccacccgggggtgagattttaaatacaatggccagctgggctccgtggcacacacctgtaattccagcactttgggagaccgaggtgggaggctcacttgagtctaggagtttgaaacaagcctgggcaacaaagcaagatcccatctgtatgaaaaatttaaaaattaggccgggcatggtggctcatacctgtaatcccagcactttgggaggccgaggagggcagatcacttgagctcaggagtccgagaccagcctggccaacatggtgaaacactgtctctactaaaaatacaaaaaaattgctgggcgtggtggctcacgcttgtaatcccagcactttgggaggccgaggcaggtggatcacctgaggtcaggagttcaagaccagtctggccaacatggtgaaaccctgtctctactaaaaatagaaaattagatgggcttggtggtgggcacctgtattcccagctactcaggaggctgaggcaggagaatagcttaaatccaggaggcggaggttgccgtgagccgagatcgaaccattgtgctccagcctgggcaacgagagtgtgaaactccatctcaaaaataaaaataaaaatacaaaaaattagccgggcatggtggcgcgcacctgtaatcccagctactcgggagactgaggcgggagaattgctggaactcgggaggcggagttgcagtgaaccaagattgtgccactgcactccagcctgggagacagagcgagactccatctcaaaaaataaaaaattaaaattaaaagttagactggtgtggtggcatgtgcctgtagtcccagctacttgggaggccaaggcgggaggatctcttgagcccaggaggtcgaggctgcagtgagccatgattgtgccaatgcactcaagcctgggtgacagagtgagaccctgtgtctaaaacaaacaaataagtaagtaaataggttggccaggcaaagccatcctgagaaggtgacatttgagcaaagactgagaaagcagccaagcaacatctgggtggggagccctggggcagccaccacagatggcgcaaaggccctgggcttgctttctccagggacacatcagaggtccgggtggcaagggcgtggatggcagggccatgggtggaagggcagaagcaacgtggataagagaggtaggcaggggtcagatcggatgtggccaacttggcttctaccctgagtggggtgggagtggtctcagggctccaagcagaggaggggtggggtcagatgtttcatctgggtccctctggctgctgtgtggaaaacagcccggaggaggatgagatctcacacagggagaccagagctgagatgactgcaccagtccaggccagagaagacagaggctcaggccagtaggcagcagtgacggggcgaagagggatcagattctggatctttctctctctctctctctcttttttttttttttttttttttttttttttacagacaaggtatcactgtgttacccagggtggagtacagtggcgaaatcatagctcactgcagccttgaactcctgaactcaagcgatcccttctcctgagtctcccaaagtcctgggattacaggagtgagccactgtgcccagggcaggttatacattttttttgggaacaccacagaagccaagcacagtggctcatgcctgtaatcccaggacttctggaggcgaagatgagaggattgcttgagcccaggagttcaagaccagtctgggcaacacagcaagaacccatctctaaaaaaaaaggaatactgctgggcacggtggctcatgcctgtaattccagcactttgggaggctgaggtgggtggatcacctgagattaggagtacgagaccagcctggctaacatggcgaaaccccatccctaataaaaatacaaaaattagctgggcatggtggcagggacctgtaatcccagctattcaggaggctgaggcaggagaattgcttgaacccaggaggcggaggttgcagtgagccgagatcacatcactgcactccagccagggtgaccatgcccagccaactatgtaaatatcctatacacacacactcttctgatttcaccaatggttttaacactcactcttacctgaatccattattattatattggttatgtttatcattttttaaattctacattccttttacaattgttagctttcctacagtaaaataactttccagtggccgggcacagtggctcatgcctgtaatcccagcactttgggaggccgaggcaggtgaatcacgaggtcaggagttcgagatcagcctggccaacatggtgaaaccacatctctactaataatgcaaaaattagccaaacgtggtggtgcgcacctgtaatcctagctacctgggaggctgagggaggagagttgcttgaaactaagaggcggaggttgcagtgagccgagattgcatcactgcactccagcctgagcgacagagcaagactacatctcagaaaaaataaaacaaaaacaaaaaaaacttccatactgtcctacctcccttccctgctccctccctccttctctttgtctctaatattttcagaatcagtatgaactcattttcttttcttttttttttttttccaagacaaattctcactcttttgccgaggctggagtgcagtggcatgatctcagctcattgcaacctctgcctcccaggttcaagcgattctcctgcctcagcctcccgagtagctgggactaccggcgcccatcaccacacctggctaattttttggtaatttttagtagaaacggagtttcaccatgttggtcaggctggtctcgaactcctgacctcaggtgatcctcccgtctcggcctcccaaagtgctgggattacaggcatgagccactgcgcccagcctctttttttcttttaattaaaacaattaaatagagatggggttctctgtctgttgcccaggttggtcttcaactcctgggctcaagcaatcctcctgtctcgggctcccgaagtgctgggattacaggagtgagtcaccacgcccagcctaagtattgctcttctgtgatgatttgcaggcaacaatcacctcttgttcatattttcattatctttccctccaccccgagcctatagtctgtcttggtcagaccccatttcttgagtgcaccaggctggagtttggacccatccacatcctcgcagctctcctgagttggggcccaacatctggcttggggaacagacagctttgccgacagcagtaacaatttggttgaaatgataactttgtcaaaaatgaattttgccttagtgtttttttaaaggttgagaatcttgtacattcttacaacatttctattttctacagttaaaaaactgtaggctgggtgcagtgactcactcctgtaatcccagcactttgggaggccaaggtgggtggattgcttgagtccaagggttcgagaccagctaggcaacatagcaaaatattagctaggtgtggtagctactcgggaggttgaggcaggagaattgcttgaacccaggaggcagaggttgcagtgagccaagatcatgccactgcactccagcctgggcaagagagctagattgtctcaaaaaaaaaaaaaagtaagttccaattactttgcagccaattattcttgctcttctatttgcaatagcagaagattgaaatagcctcctagatgtctgacagtggaatgggttcttttctttttcttttttggtagagatgagggtctcactatgtggccaggcaagccttgaactcctggcctcaagtgatcctcccgcctctggaggcaggaggtagggtacagtcccagactcaaagcactgggattacaggagtgaaccactgcgtgagcctggtttcttttctttcccctccctcccttccttccttccttccttccatccgtccttccttccttccctccttctctcctctttcactctacctctttcttttcttcttttttctggcttgttaaaacagaaatacataataattatagtgaaataaactagggtatttactgcagcagttagtaataatgaaatgttggaaaacaatctaatgttcatccgtagggaatatttaaaatatagtgtatttctgccgggcgcggtggctcacgcctgtaatcccagcactttgggaggccgaggcaggtggatcatgaggtcaggagatcgagaccacggtgaaaccctgtctctactaaaaatacaaaaaagttagccgggcttcgtggcgggcgcctgtagtcccagctactcgggaggctgaggcaggagaatggcttgaacccgggaggcggagcttgcagtgagcagaaatcgcgccactgcactccagcctgggcgacactgtgagactccatctcaaaaaaataaattaattaaaaataaataaataaataaaatatagtgtatttctggccgggcgcggtggctcactcatgtaatcccggcactttgggatgctgaggctggcagatcacaagatcaggagatcaagaccatcctggctaacgcggtgaaaccctgtctctattaaaaatacagaaattagctgggcatagtggcatgtgcctgtagtcccagctacttgtgaggctgagacaggagaatcgcttgaacctgggaggtggaggttgcagtgagctgagatcgagacactacgctccagcctgggtgacagagcaagactccgtctcaaaaaaaaaaaaaattatagtgtatgccatggaatattatgcaactgttatatatgtgtgtgtgttcccaaagcattgttcagtaacaaaggaaaagtgcaaaacactaaaatggatgaatacatgcttgtgtaaacacagacactgtcaggaatgtttgtctggaggtgatgggtatggagcctttttgtctgatatattgggtgtatcaagaatgccaggtcctgagcagttttttttttttttttttgagttggagtctcactctgttgcccaggctggagtgcagtggcacaatctctgctcactgcaacctccacctcctgggttgaagcgattctcgtgcctcagcctcccgagtagctgggattgtaggcgcccgccaccatgcccagctaattttttgtgtttttagtagagacggggtttcaccatgttggccaagctggtctcgaactcctgacctcaggtgatctgcctgcctcggccttccaaagtgctgggcttacaggcatgggccaccgtgcccagccgtttatatgtattaactcttaatcatcaaaacaaactatgtggtattaccataattatcgccatttatacaaagcaacagagggataaggagattaaggcacttgcccaagtgcaagaggtaggacaggaacccagagtcccgtgctggtagctgcttttctgtgcacttaacattatctcatttaattcttgcagtcacttcatgaagaaggtggcggtcctagggcattggagaagttatgtgcttgttcaaggtcatgcagctggaagatggtggtggtaggacaggaagtctgtagggcctgattctgcagccctctagtctatactcctttgctcctgtgtccctcatcccccctgcagaatgggcaccccgttacctttctgagccactgtgcgcagaaaagagagcatgttggccaggctggtctcgaactcctgacctcaagtgatcagcctgccttagcctcccaaagtcctgggattacaggcgtgaaccaccacgctcagcctctgaatactttgtactcaagccatttttcagtgctgtgtttgcagtgagcacacccgagggatgaagacacgtctccctgtgggaacctgggcttaccagggcccctagaggaggggaatctctcaagctcagagctctatggctgcggtgcaggcccactgtgtgcatggtgtcagtctgggcccttccatgttgcccccgtgggacttggggtaaggggaactgatgcaaacatcacgctgctgttgcttggtgtgagcaattaattcctgtggctctcacccaggagtctcatgtctttgggtcagacaaactcatcagcttgtagaaatggcacagtcccacgggcctgttagaatcttctattgtgcacatgttgctcttaaaatatacaaatcagttttgattttaaaaaattatttatttttttagtgataggagttttgctacgttgcccaggctggtttcaaactcttgggctcaggaggtcctcccactttggcctggactgccagcataatgtatcaccacacccgggactgattttcgtttttcaagaacaaaaaccaaaaacatacacaaaccgagagtcaaagcttgctaattagaggaaagtcaggaaatgggaaccattcaaagaagaaaatacccccacctcctactctcacctatccaaagacaattaggtgaatcccttagtagatatctttccagacggttttccatatagattcccatatctggccaggcgcggtggctcacacctgtaatcctagcgcttggggaggctgaggcggatggaccacctgaggtcaggagttcgagaccagcctgaccaacatggagaaacctcgtctctacgaaaaatacaaaattagccgggcacagtggtgcaagcctgtaatcccagctactcaggaggccgaggcaggagaattgcttgaacctaggaggcagacattgtgctgagccgagccaagatcatgccattgcactaaactccgccttaaaaaaaaaaaaaaagattcccacatctttactagtttgcagaaataagatcctagcatatgcagtgtgtaggaaccaccttggtttagccacgtctctgtgactgggggccactgtggtgacccccagctccccggacagagtcaagagctcaccagcctgcaaaggttttcacggcccccagccagactcgggggcttcctcttgccctgctacttcctgggagctctgagggcaggaaatggcgccactcagctcctggcctaacagcttggggaccacaaatgcaaaggaaaccaccctcccctcccacctcctcctctgcacccttgagttctcaggctcacattcccaccacccacctctgagcccagccctccctagcatcaccacttccatcccattcctcagccaagagccaggaatcctgattccagatcccacgcttccctgcctccctcaggtgagccccagacccccaggcaccccgctggcccctgaaggagcaggtgatggtgctgtcttcgcccagcagctgtgggagcaggcgggtggggcaggatggaggggtgggtggggtgggtggagccagggcccacttcctttccccttggggccctgtccttcccagtcttgccccagcctcgggaggtggtggagtgacctggccccagtgctgcgtccttatcagccgagccggtaagagggtgagacttggtggggtaggggcctcagtgggcctgggaatgtgcctgtggcttgaaaagactctgacaggttatgatgggaagagattgggagccattgggctgcacagggtcagggaaggccaggaggggctggtcactgctggaatctaagctgctgaggctggagggagcctcaggatggggctgatgggggagctgccagcatctgttcctctgtcatttctgataacagtaaaagccagcatggaaaaaaccgttaaaccgcaggttgggcctggccgttggcagggaagtgggcagaggggaggcccggccaggtcctccggcaactcccgcgtgttctgcttctccggctgcccacctgcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctctctctcacacacacacacacacacacacacacacgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctcaaaaaataaaaataaataaaataaataaaagagaggcacaaacagtgttatgaatgcaccaaggaaaatggtgcattcataactctcaggtgaagcctaccaagccatgcgtgtgtgcacatatgtgtgtacgtgtgcatgtgcgtgcgtgcatgtgcgtgcgtgcatgtgcctgtgtgtgtatgtgtgcacatgtgtgtgcgcatgtgtgtgtgtgcgcgcatgtgtgtgtgcatgcatgttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaatttttttttttaatttttaatttgtacagacagggtcttgctgtgttgcccaggctggtctcaaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgagtctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttggaaaaaaatttaaaaaaagaaaatataaaatatggtataagattaaatatattagttatgaaaataattgtaaatggcttattgaacttatagtcagtaaaaatcatgtttttgaaaattatgtaatgactttggaaaataccagcaatataatgttaagtggggaaaaaagcaagttactcctctgtaatacatatgattttagttttgtaataaaaattcccaaccatatatgcacttatagggaaacaaaggacccatcgcaaatgttttccatgctgatctccaaagtggtgagtttatgtgtgatttttattttgtttatgctcttctgtattttccgaatttcatacaataaatatctgttacttttacaatatgaaaaaatagtggtcaaaaaggtgttcaagggggtggcctgggggtgtctggtttgaggagagtggtaggggatgaggctgcaagtggaggttggagccatgctatgaaaagttcaagagtttgaattgagttctgaggtttgtttttgtttttgtttttgttttttgagacggagtctcaccctgtcacccaggctggagtgcagtggcacgggttcatgccattctcctgcctcagcctcctgagtagctggaaccacacgcgcccgccaccacaccaggctaatttttttgtatttttaggagagacagggtttcaccatgttagccaggatggtctcgatctcctgacctcgtgatccacctgcctcggcctcccaaagtgctgggattacaggcgtgagccacagtgctctgcgtgagccatagtgctctgctgagagtttgaattgcattctggaagtagtggtgaaatcaacacacctaagtctgctcttctcctctcttctagtccccagagtggtgagtagcatcgttctggtggcccaggcaaaacgccttaggaccaccgtgcagccccactctttccccattcctgctctccaggtgccaagtccctggctcttcttccaccgacccttgcatcccttccttctcttcagtcctcatcgcacctcaccgggatcctattgacacttcccctttgatttccttccgctctctgctagtgatggtcccagggacccttctaaaaggtcactgtgggctgggcacagtggctcacgcctgtaatcccaacactttgagaggctgaggtgggccaatcatctgaggtcaggagttcgagaccagcctggccaacatggtgaaaccccatctctactgaaagtacaaaaattagccgggcgtggtggtgtgcacctgtagtcccagctactcgggaggctgaggcgggggaattgttggtccccgggagatggaggttgcagtgagccaagatcgcgccgttgcactccagcctgggtgacagaatgagactccgtctcaaaaaaaaaaaaaaaagaaaaaagaaaaatagctgggcatcgtggcacacacctgtagttccagctactcaggaggatgaggtaggaagatcacttgagcccaagaggtccagactgcagcgagtcatgatcacaccactgcactccagcctgcgtggcaccctgtctcaaaatataataataataaaatttaaaaataaaataaaacgctgctctgtctaggtgatattcctctatccccaaggctgtcagggtggaaccctccttccttagcgtggcatataagcccctcgggacctggccctatctctcctctgaccacccctgcccggtcagcccttgttacagacagtctgtgctatccagccccatcaaattcctgttgctccctaaatatgccacacactttatttggaggagaggggtgaagaagggtagtttaacatgttcaaaatatttattttttccagacagtaaaataacattttttcctgttttgcaaaagttaattatcagcacattgaagattttccttttttttcttttctttttttttttttttttgagtcaaagtcttgctctgttccccaggctagagtgcagtagcgcgatctcggctccacctcccgggttcaagtgattatcctgtttcagcctcccgagtagctgggactacaagcacatgccaccatgcccagctaatttttgtatttttggtagagacggggtttcacaatgttggccaggctggtcttgaactcctgacctcaggtgattcacccgcctcaccctcccaaagtgttgggattacaggcatgagccactgcgcccggccagcagtcttaaataacagaattcacacacacacacacacacacacacacacacacacacacgcactgtattatatttcatcttatactttaaaatgtttccttttttttcctcaaaagtacacattaagatcatgtttacaaataaagccttgtcatccaaagtgaaaaatccagatggcaagatttggatggggaaggtcttgagaaatctgcgaatggagttcacttttgcagacaggaaatgggccctaatatatggttctaaggacattccatttctgaaaatgtacatttccacccgcttttcctctccttccttcctccctccctccctccctctctctctctctctctctctttctttctttctgacaaggtcttcctctgtcgctgacgctggagtgcaatggtgcgatctcggcccattgcaacctccgcctcctgggctcaagtgatcctcccccctcagcctcccaagtagctgggaccacaggcacacgccacggcacccagctaatttttgtattttttgtacagatgggttctcaccatgttgcctaggctgatcttgaactgctgggctcaagtgatcctcccgcctcagcctctcaaaagtgctgggattacaggcgtgagccaccgcacctggcctgcatccccatttctgacccttgaccatgttcaagtgggaaggggaagccggggaagggaggacgggctacctgagggctgcgggtagaggtgactcctgtgagctgtgagccctcagcccttgggcagagggaacagaacagaaacagaccccatctctgagccaccaagctcagactcgtgtggcaggagacagatcacacaacactatcaacaaaacaacacaggtcgcagtggctcacacctgtaatcccagcactttgggaagctgaggtgagaggattgcttaaccgcaggagttcgagaccagtctggccaacatagcgagaccccatctctcaaaaaaagaaaaaaattagctgggcctggtgatgcacacctgtagtcccagctacttgggaggctgaggtgggaggacagcttgaaccagagaggtcgaggctgcagtgagctatgattgtgccactgccactgcactctagtctgagcaatagagtgagaccctgtcttccaaaaaaaaaaaaaaaagagagagagagagagaagaatataatcaaaagtttctaaattcccaaagtagtaacaaaagcagacccaaacaaaagtagagagaaaatcttcgaaacttaaaaggctatttaggctaaggagcccacccagtggtgaccacctagttctgggaggtttggggcagggccattagacaatggaaactcaggttattttggagacaatcaacttgctcccaaaaatgagctgcaagcaggtgcctgtgtgctcagcccagtctggagctcagagcctgcctgccccactgcaccatcaccagcccagctgaaccagggtcccaggcaagccgtacaggctctgcgttggccttggagagaaccgccgactcccccgagttgcctgagctcggcctgaagccagccctccccacgctggctcacaataaatgccttgacttcccgccaactcttcctcaaccattaagattcagctcaactgtcacgggctctgtgcagctgccctcgctgccccaccccacgcagactttgtgttccttctccactcctgcagcaccccttgcgacagcatgaataacccggctgtagtgatgtgagggtgacactcatcaccagtgtgtgagcccctccaaggccacatgtcctctttgtgtttccagagcccagggcccagcatgcggtagctacctagtatatgtttactgaatggagggatgaataaattcatgcacaaagaatagttttatttatttatttatttttgagacagagtcttgcttctgacacccaggctgtagcgcagtggtgcgatcttggctcattgcaacctctgcctcccaggttcaagcaattctcctgtctcagcctcccaagtagctgggattacaggcatgcgcgccaccacgcccggctaattttctatttttagtagagacgaggtttcaacatgttggccaggctggtctcgaactcgcgacctcaggtgatctgcctgccttggtcttccaaagtgctgggattacaggtatgagccaccgcgcctggccttatttgtttattttcataaacaaatttctgttgcccaggctggtctcaaactcctggcctcaagtgatcctcctgcctcagcctcccaaactgttgggattacaggcacaagccacagtgcctggcccagttctgtcctttgagttgacctggtcatccaggaggatgttctgaggaagtgtgaaatgataatattattctagcccacgctggatacagtggcagtctggaaggtgaaagaggttgggtttgaaatagatttattggccaagtgcagtggctcacacctgtaatcccagcactttgggaggccgaggcaggagaattgcttcagcctttaaacatggcgaaaccctgtccctattaaaaataaaaaagttcgatgggcgtggtggcattcacctgtagtcccagctactcaggagggtgaggcaggagaatcacttcagccctataggttgaggctgctttgtgctgtgatcatgccaatgcacgctagcctgggtgacacagtgagaccctgtttcaaaaacaaaaacaaaaacagaatagaggcctggagcttgagagggaactcaggatagaagatatagatttaagagtcggctggatgcagtggctcaaggctgtaatcccagcactttgggaggctagggtgggtgtatcacttgaggtcaggagttcgagaccagcctgaacaacatggcgaaaccccatctctaccaaaaataacaaaaactagctgggcatggtggcatgcgcctgtaatcccagctacttgggaggctaaggcaggagaatcacttgaacccgggaggtggaggttgcagttagccgagattgtaccactggattccagcctgggtgacagagtgagactccctctcaaaaaataaaaataaaaataaataaataaataaataaataaatagtgatacagatagatagatacataaattatatcattcactgggtagattgagaagagagctgtagagagaatctgagtgtaatagtcagggcaggctaactgctgtaagaaacagtgcccccacatctcagcggtataactcaaaagaagttttttccttcttatgacagtcaattcctgacatctggagcatgacctttcacaacattattccgggacccagtctccttccatctagtggctctgtcatcctcctagggccttggagtggtctgcttttgaccagctaatgggaggggagaggcagaataggatcctgtgaagacttctagggtcaggtctggaaatatcttttgctcacactccattggccagaacaagactgcctcagtgcagaggaagctgggaaatgtagtttagtagggtacccagaaggaaaagggaaacagtctctgccacactgaagcaacaccaaaatctgagggttggatgtaggaagaagcacctgcaaaagatagaaaagagcctttaagaggatcacctgaagccaggagtttgagaccagcctgggcagcatagcaagatcctatctgtacaaaaaataaaaataaaaaattagcctagggtggaggcatgcacatacagtcccagcaactcaggaggcttggggccaggagtttgaggctgcagtgagctttgattgggccactgcactccacttaagcctgagtgacagagcaaaaccctgtatccaaaaaaaaaaaaattaaccaggagaaaaatgacatttggagatcctgtctctaaagaaaaaaaaagctcactgcatagctcactgcagcctcagaaacaggcccaggactgaatcaaggccagcaaggtgctggggtgataagcgagcccgactccagcctggccaacacggtgaaaccccttctctactaaaaatacacaaattagctgggcatggtggcagacgcctgtggttccagctactcaggaggctgaggtaggaggatcacttgagcctggggcgtggaggttgtagtgggccaagattgtgccactgcactccagcctgggtgacagagcaagaccctgtctcaaaaaaaaaaaaaaaaaaaaaagtgagctggaggatgaggcctccctaaattttgtgccttgggtgtctcgatccgtcacgccagccccagtcccggcagtcaggtgcggcagagaaagcaaagggagaaggctgggaagatgcaagtgaatttagcgactagcagtccctgtgagcaactgtagcaagaagggtttccaatgaagaaaggaaggccctgggccaggcgcggtggctcatgcctgtaatcccagctctttgggaggcagaggcgggtggatcacctgaggtcgggagctcaagactagcctgaccaacatagagaaaccccgtctctactgaaaaaaaatacaaaattagccgggtgtggtggcgcatgcctgtaatcccagctattcgggaggctgaggcaggagaatcgcttgaccccgggaagcggaggttgcagtgagtcgagatcacgccattgcgctccagcctcggcaacaagagcgaaactccatcaaaaaaaaaaaaaaaaggaagaaagaaaggccctggcagttcttggacaggaacttgcctgaagtcccagtcccggtgactggtggtttccccactttctggttcagaagctgggctctaagctgtctgtgcccttaaagttccttggaaagagggaagggaagggaagtggatattaggtgagttcctactctgtttcatttgcagagttttctcattgattctcagttggacccatgaggtagatgttatgccattacattttttttttctttagagacagggtctctctctgtcactcaggctggactgcagtggcacgatcacggctcactgcagctttgaactcctgggctcaagtgatcctcccatctcagcctacaggtgtgcaccactgtacttagctaatttctttttcttttttctttttttgggagagatgggatctctgtatgtctctatgatgcccacactggtctcaaactcctggcctcaagcgattctcctgccttggcctcccaaagcacagggattacaggcatgagtcgctgtgcccagcctgttatgccgggtttttttgttttgttttgttttttgagacagagtctcgctctgtcgcccaggagtacagtggcatgatcttggctcactgcaagctccacctcccgggttcacaccattctcctgcctcagcctcccgagtagctgggactacaggcgcccaccaccacacccggctaattttttggttttttagtagagacggggtttcaccatgttagctgggatggtctcgatctcctgacctcgtgatctgcctgcctcagcctcccaaagtgctgggattacagtcgtgaaccactgcatccggcctgttatgccgttttttaaattaattaataaatttatttatttatcttgagacagagtctcactctgtcacccaggctggagtgcagtggcatgatctcgactcactgcaacctccacctccggggttcaagtgagtctcatgcctcagcctcctgagcagctgggattacaggcggccgccaccatgcccggctaatttttgtatttttagtagagatggggtttcgccatgttggccaggctggtctcaaactcctgacctcaggtgatcaacctgcctctgcctcccaaagtgctgggattacaggcgtgagctcctgtgcccggccctgttatgccattttaaagctaaggaaactgaggcacagaaaaaggtaaaaaggtacttgagatcaaaaaggatggagttaggatttgaacccaggtccagggcccatgattttcccagcacaccatccaaaatgcctgcctgccctcaccagggagcacatgcttacattcacagccttggaccctgggttagggccaggagggctgggtgttgggtgagaacagggcctcgggctccttcactggctggggcagggcttctgagttccccatcagagcccctcctctgactttcagggcctgctgaggaatctgcaggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggtaaagggacactctctctgccatgtccctgcacccatccccccactgcctacccctgcccccaccctggcttgtctcagccccttgttgcctcctctggagtcatctctcctctggtcccgccatcgactcccttacctaccccatgtccctgcagccttgctcaacccccagaggccccttctcactcttctttctcctgtgttgagtccccaaggagctctggggaaggaaggggcttaagccctagaaaagggcagggtggcctggaggaggtggcgtctcctgggggcagtgggggccggaagtgggaggctggttgggggagcagcatggacttctgctctcgctggtagctcgggagaagcagagacaaagtcctgtcccttctgcagctgggtgggggagggggcttgagtcccgtgattccctgcctggagggagctgtatgcaaactgttggggtgatcagtcccaacccccaaccatgaagtccggtggcaacaaaggaatgagaaaagacaagttaagatttaaagcagccccagggggccagttgctaaagtgaaggctgcagagccctggttgcctgataatttattgagtacaatcttttgatctaagaagcagatggtacggggtgaaacggtgaaggtgggggtgtgcgcgtcatttgaaagatgtatagccgtggtggtttatgtgaatttcctttaagctcaaagcatatgtctaactactaagataatcttttttttttttttttttgagacggagtctcgctttcccccaggctggagtgcagtggcgtgatctcggctcactgcaagctccgcctcccgggttcatgccattctcctgcctcagcctcccgagtagctgggactacaggcgcccgccgccacgcctggctaattttttgtatttttagtagagacggggtttcaccatgttagccaggatggtctcatttcccaacctcgtgatccgcccgtctctgcctcccaaagtgctgggattacaggtgttagccaccgtgcccggccaactaagataatctttaacttattgggctgcagctggtgggagtgggttttacaaggagccaggatgtctggtcacattccaacgcttcaaggaagtgtttcagcccagagcattctgtgtaaagccgcagagcaggtcatgttcactggcctggggacacaatggcaataaggaggtgattctcctcagaggccccctatggtgttccataggtgtcctacacaggggtggctgactaaactggcgccccgtaaacccttccaccagcacaaacccaggggtccatgctctacgctcagaaggctccaccagggatggggctgtgtgaccatgggtgggtcctggcttctcagagtcccgttttcttccatctgtaaaatgacaataatagttccctgctctggcccgccacggtggctcacgcctgtaatcccagcactttgggaggctgaggtgggtggagcacttgaggtcaggtgtttgagaccagcctggccaacatggtgaaaccccgtctctactaaaagtacaaaaattagccgagtgtggtggtgcgcacctgtaatcccagctacatgggaggctgaggcaggagaattgcttgaaccccagtggcggaggttgcagtgagctgagaccaggcctcagcactccagcctgggcgacagagcgagactccatctcaaaaaaaaaggaaaataaatagttccctgctcagaaggttgtggggaggacagaggatgggaggcacaggtgcttagaccctcctccatgtttgaggtgcctgctggccccatacacccggtccctctggctccactgtggaaccagctctcaggggtcccatgcaggatgccacgccaaacacctttcaatctccattgtgtctttctcttttgaaacaacgccgacctggatgtgaatcctgactgccactcagcagcagtggaaaccctggcaagttttgtaacctgtagaagcccgtttccacatctggacaatggagttggtggcactggtctcacggggttgtaatgaagattaaataccttagcagatgtcaaggggtctcgacctgattccttcagagccaggattctttactgagggatcagggatgggctctgggggagttcatgaaccccagaatttgcaggtgaaattgtgtgtctttgtgagaacacggttacgcatttttctgggaaggagatccataattttcatcagatccagattctttttttttttttttttttttgagacagagtctcgccctgttgtccaggctggagtgcagtggcatgatcttggctcgctgcaacctctgcctcccgggttcaagcgattctcctgcctcagcctcacgagtagctgggactacaggcataaaccaccatgcccggctaatttttgtatttttagtagagatggggtgtcaccatgttggccaggctagcagatccagattctttttttttttttttcgagatggagtctgactctgtcaccaggctggagtgcagtggcaggatctcggctcactgcaaccttcacctcccaggttcaagtgattatcttgcctcagcctcacgagtagctgggactacacgtgcttcaggcacttgctgccatgtccagctaattttgtagttttagtagagacagggtttcaccatgttggccaggatggtctcgatctcttgaccttgtgatctgcctcctcggcctcccaaagtgctgggattacaggtgtgagccaccgcacccggcctcttttgttttttagacggggtcttgttctgtcacccaggctggttggtgtgcagtaacataatcatagctcactgtttgtagcctccaacttctgggctcaagtggtcctcctgcctcagcctgtggagtagctgggactgcaggcgtgtgccaccacacctggctaattaaaataaattttttttttttttagagatgggttcttgctgtgttgcccaggctggtctcaaactcccagcctcaagcgatcctccaacctcagcctcccaaaagtgttgggattacaggcatgagccaccgtgcctggctcaaatcttttcatatgtgaacatctcagcatgttttctttctttcttttttgagatggagtttcgctcttgttgcccagactggagtataatggcgtgatcttggctcactgcaacctctgcctcccaggttcaagtgattctcctgcctcactctcccaagtagctggggatacaggtgcccaccaccatgcccagctaatttttttgcatttttttttttagtagagatgggttttgccgtgctggccaggctggtcttgaactcctcacctcaggtgatccacccaccttggcctcccaaagtgctgggattacaggcgcaagtcactgcgcccagcctcatcatgtttttttcttaaaagataaagacttttctttttactacaaccacaatactattgtcaaaactaaactttaaaaatttccttggtgttatcaaacattcaatgtccagattccagtggtttcataaatagcctaatttgcttttagtttgtttgaattaggatctaagtaaaatctacactttgtgattggttagtatgttttaagagtctttgaaactttatttttttgattaaaaaatgtttaatttagagataggggtctcactatattgcacaggctggtctcaaatgccccaaagtgctgggattacaggtatgagccaccacacctgactgattctttttttttttttttgagatggaatctcactctgttgcccaggctggagtgcagtggcgcaacctcggctcactgcaacctccgcctcccagattcaagcgattctctcaccccagtctcccgagtagctgggattacaggcgtgcaccaccacacatggataaattttgtatttttttagtagagacagcgcttcaccatgttgtccaggctggtctcgaactcctgacctaaggtgatcttaggcccaccttggcctcccaaagtgctgggattacaggtgtgaccaccacgcccagccaatatgtggtcttatgagagcattggttcttttttttttttccctgaggcagggtctcaccctgttgcctaggccagagtgcagtagctccatcatagctcactgcagcctccaactcctggactcaagggatcctcccacttcagccttctgaatagctaggactacaggcgtgtgtcaccatgcccagctaatttttaaaattgtttttgtagagatgggttctcactatgctgcccaggctggtctcaaactcctggcctcaagcgatccttctgcctcggcctcccaaagtgttgggattacaggcatgagccaccgcccctggccgagcattgattcttgatcctcatgtgcatctgagtcacagagcagggtgggggctggctcttccccaacctggatccctggaaactacccccagagattctggttcactgggttggaatgggcctgagcatctgaaagtttgaaaagctccctgtgattctggtgtgcagcccaggcagaggccccactgtgtccacttctcttgaaaggagtggttcacaccaacacccccacttccctacctcccgtgcgctcctcgagcatgacaatgtggcttctgcccccgacacatggcacaaaaaccgctctggcacaggcctcacagttgctaagtgcagagccccatcctcagtcttccttctatttacttctgctcacctcccaaaaccctcttctccttcccaggtacccactcctgatgatgcttctctttttgttggacatgccctgtgggttctttatcttattattttattttagagaccgtggcttgctctgtcacccaggctggagtgcagtggtgcaatcacaggtcactgcagcctccaactcctggactcaagccgcagcctcccgagtagctggcgagtagctgggactacaggcgtgcacccccatgcccagctaactttttctttttttcttttgttttttgagacggagttttgctcttgttgcccaggctggagagcaatggcactatctcggcttactgcaacctctgcctcccaggttcaagcgattctcctgcctcagcctcctgagtagctgggatcacaggcgcccaccaccacgcctggctaatttttgtatttttagtagagacggggttttgctatgttggccccggagttcaatttttgtatttttagtagagacggggtttcaccgttttcaccaggatggtcttgatctcctgacctcgtgatcctcccgcctcggcctcccaaagcgctgggattacaggcgtgagccaccgcgcctggccacggcagcatctcttctgaactccagagccattccctaccaccctctgggcaccaccatccacatctcctgctgccgcctcagccttaacctctgcaaaaccaaatccgttctttctctcgagctctgcagaagctaagctgtttcaccaggccacgattcaggaaacgctttgggattcagcttctgttcttgtgaaatgggaagaatccctgtggtgagctccagatgagagcacaaaggggaacaggggtgcccgcggctggcacgccatggctggcacgccatggcactcagtggggtcaccgccccctcctgctgtcccacctccaccctgcctgctcttctcctggaatgactccttctgccagctctcagctacccaggccagaggcccaaggctcccacatctctttagctactaattctggtagatccccttttggaaatagccctcaaatctaccccagagctactgtcaaagttcagggctccatctcttttggtttttttgaaaatattttttcaaattaattatttgttggccgggcgcagtggctcacacctgtaatcccagcactttggaaggccgaggcaggtggatcacctgaggtcaagagttcaagaaccagcctgaccaacatggtgaaaccccatctctacaaaaatacaaaaattagccagggatgatgctgcatgcctgtaatcccagctactcgggaggctgaggcgggagaaccacttgaacccgggaggcagaggttgcagtgagttgagatcacaccattgcactccagcccaggcgacagtgagactccgtctcaaacaaaaaaaaattatttgtggaggcagggtcccactatgttgcccaggcctcaagtggccctcctgccttggcctcccatagcactgggattacaggtgacagccaccgcgcccagcctactttttgtctggccaagactacctcagccttcttttgcctcccaatctgtctccagttggtggctgaagtgacccttctggagcaaaaccataatcatatcactccctcttttaaaattctgtgatgggtcaggcatggtggatcacacttgtaatcccagcactttgggaggccgaggtgggaggactgcttgagcccaggagttcaagaccagcctgggcaacatagcgagaccccccgtctctacttaaaaataataaaataaaatgaaaagaaaattttttttgagatggagtttcgctcttgttgcctaggctggaatacaatggtgggatctcagctcacggcaacctccacctcccgggttcaaccgattctcctgcctcagcctcctgagtagttgggattacaggcatgtgccaccatgcccggctaattttgtatttttagtagagacggggtttcaccatgttggtcaggctggactcgaactcctgacctcaggtgatcggcccacctcggcctcccaaagtgctggaattacaggtgtgagccactgtgtccggccaataaaatgaaattttatgatggcttctgcgatctggccaaattcctcagctaaatagtttagttctttctccctgtggcctctcctcccaccatgtcacctgtgaatcccacactgcccccaccccgacactgtctgcaggtgaacagatcagttttctcagccccaaatgtcagccccaccccacacctctgcctggcaaacatcactcaccggtcctcagagacacctagtcatttattccatgagtccaccacacttgagaaacgcttcttttcttcgcgagcacgcctaccctgtgctagacagtgttcctaagggctttcaaacataaagtcttttgttttttgtttttgagacgcagtcttgctctgtcgcccaggctggagtgcggtggcacaatcttggctcactgcaacctccgcctcccaagttcaagcaattctctgcctcagcctcccgagtagctgggattacaggcgctcggctttttatttttttaattttttttattttttgtatttttagtagagacggggtttcaccatcttggccaggctggtcttgaactcctgacttcaagtggtccacttgcctcggcctcccaaagttctgggattataggcgtgagccactgtgcccagcctccaactcctggccttgtcttcctcccaccctggcttcccagagtgctgggattaacagacatgagcctccacacctggcaacttctttccatttttcactgattctctgacacatcctcattgagcacctgcactgtgtggggtgttaataattgctaggcatggaggcaacagcgtgggcagctctttctcttacttgtcaggctttagcctatgctgttgcaggactgtgccttggcctggaagccccttcccttatcctcatccccaatctcccccttcagctcttgttcctcttgcaggtcttcccttaaacatcacttcctcagcaggggcctcacagacacgcccggaggttagatcctggtccctctgtgcttcctgttcttcccccatcatcacagtctacggctgtttcctctcgatgggcaaagactgtgtctggccattgagttttctgctatatccaagtgcttcgtatactgaaccatataaatgtgctgcttttattggtcaaaacggccaaatattggcaattttatattggttagcttcatagtatgtgagctaggatacttatcccatcagagaggttgcgtagcacagtgaatcagagcccaggctctggggccgcacacctgaggtccagccctggctctgccacttgtcactaagtgattgtggactggagacaaccctcaggggccttgggttcctaatctgtgacagggatgacaataatgacctcctcgtgctgttataaaatacagaaatgtactaaaatacaaaaattggccaggcatggtggcacatgcctgtaatcccagctactcaggaggctgaggcaggagaactcaggaggcagaggctgcagtgagtctacttttattgccaaagctcgggggtccatcccttttccattgcatgccactgcactccagcctgggcaacaaagtgagactgtctcagaaaaaagaaaaagaaaaaaatgtttaaaagccaggagtttgagaccctgtctctattaaaaaaaaaaaaaattaccttggcatggtggagcagctactcaggaggctgaggtgagaggaccacatgagcccgggagttcaaggctgcagtgagccatgattgcaccactgcattccactctgtctcaaaaagaaagaaagaaaaaagtcaagagaactggagctgaaaccatgaaaggtcagttttcagcaggagagtgatcaaagaaaaccagaactagacagtcgttaaaatagcaaaaacatattgcattccagactattgctgtaggggaagagtgaccttagatcagaactgggctgaactctacaccatgggggttatagccaacgagcagagttgggggcagtggatgggacattaccatgagaaagcactgggggttgggggtattctgacaagaccaacctaaagggattcttgctgagggcaggccaaggtggtcagacagcgcctgggggagagtggagaatgaggacccccatcagggatcgggggcaatcagatgtggaggatgagggactggctaagctgacttagcagtattcttgctaaaattggacgatgcagaggtgaacacggaagtccaaggcctaactggaaaagagctgagggaacctgagtgaggtttggctatagacagaacctctgagtgagcccatcaaagttactttatttatttgtttgtttattaatttatttaagacagagtctcactctgtcgcccaggctggagtacagtggtgctatctcggctcactgcaaactctgcctcctaggttcaagcaattctcgtgcctcagcctcccgaggagctgggattacaggcacatgccaccacacccagctaagttttgtgtttttagtagggacagggttttgccatgttggacaggctggtcttgaactcctgacctcaggctaattttttgtttgtttttattctctttttttttttttttgagactgagtttcgctcttgttggccaggctggagtgcaatggcgcgatattgactcactgcaacctctgcctcctgggttcaagcgattctcctgcctcagcctcccgagtagctgggactacaggcgcacaccaccatgcccggctaatttttgtatttttaggagagacggggtttcataatattggtcaggctggtctcaaactcctgatctcaggtgattcgcctgcctcagcctcccaaagtgctgggattacaggcgtgagccaccgcgcccagccttttgtttgtttttaaatttaactttttttttgagaccgaattgcactctgtcacccaggatggattgcaatggcgcaatctcagctcattgcaacctctgcctcctgggttcaagagattctcctgcctcagcctcccaagtagctgggattacaggcgcctgccaccacagctggttaatttttgtgtttttagtagagatgaggttttgccatgttggacaggctggtcttgaactcctgacctcaggtgatcaacccaccttggcctcccaaagtgctgggattacgggcatgagccaccatgcccggccttaacttttatcttaagttcaggggtacatgtgcaggtttattatataggtaaacttgtgtcatgggggttgtacacattatttagtcacccaggtattaagtttagtacccattagttatttttcctgatcctcttgagggaagagagagaccctctcatattgtttcatactcagaaaaggaaagagaagcgaaactaaaggcaggtagcctggtgcctaggaaccagaccggaaaccaaggaaccagacccgaaatcaggcctgggcgtgcctgacctaagcctggtagttaaaattcgacccctgacctagcaactgttgttatctatagattccagacattgtatggaaggacattgtgaaacctcccgttaggttctgtttcactctgaccaccggtgctcgcagcccctgtcacgtaccccctggcttgctcaatcacgaccctctcacgcggacccccttagagttgtgagccgttaaaaaggacagaagttgagcacctgaagagctcggattttaagacgctagcctgccaatgctcccagctgattaaagccactcccttcactatcttggtgtctgaggggttttgtccacagctcgtcttgctacacttgccctcctccaaacttccgccctccaataggctccagtatgtgttattcccctctatgtgtccatgtgttctcatcatttagctcccacttataagtgagaacacgcggtatttggttttctgttcctgcgtttgtttgctaaggataatggcctccagcgccatccatgtccctgcaaagaacgtaatctcattcttttttgtggctgcatagtattccacggtgtatgtgtaccacactttctttgtccagtctagcattgatgggcatttaggttgaatcatgtctttcctatggtgaatagtgctgtgatgtgtctttataacagaatggtttacattcctttgggtatatacccagtaatgggattgctgggtggaatggtatttctggtttttggtctttgagaaattgctgcactgtcctccacgatggtttaactaatttacactcccaccaacagtgtataagtgatcctttttctttgcaacctcgccagatctcggtggtcaactcctcccactccccaggcaatgctgatttgctctgtgcctatagttttgcctttcccaggatgctgcgggaatgggatcatacggccttttggatctggctccttttagttagactgatacatttgagacaggtccctattgttgtgtgtatcagtagttggtttcttctttttttgagatggattctcagtctgtggtccaggctggagtgcagcggcatgacctcagctcactgcaaactccgcctccctggttcaagtgattatcctgcctcagcctcccaagtagctgggattacaggcacatgccaccacgcccggctagtttttgtattttttcgtagagatgggatttcaccatgttggagaggctggtcttgaactcctgacctcgtgatctgcccaccttggcctcccaaagtgctggaattacggcgtgagccatggtgcccagcctgcatcacaggttgtttacccaatactcaccagttgcagaattcaaatccattttttaaaaaatcagcctgaaaaaaaaagaaaaaaatcagtctggccaggcacggtggctcacgcctgtaatcccagcactttgggaggccaaggcgggaggatcacctgaggtcaggagtttgagagcagcctggccaaaatggcaaaaccctgtctctactaaaaatacaaaaattagctgggcgtggtggcgggcacctgtaatcccagctacttgggaggctgaggcagaagaatccctggaacccgcgggacggaggttgcagtgaggtgacatcaggccacttcactccagcctgggcaaaagagtgaagctctgcatcaaaaaaaaaaaaaaaaaaaaaaaaaaaaaatcagggtgggcacagtggctcactcctgtaatcccaggactttgagaggctgaggtgcgaggattgcttaagcctgggagttcaagacgaggctggggaatatagtgagacccccatctctacaacaaaaaatatacaaaaattagccgggcatggttggtgtgcgcctgtagtcccagttccttgggaagctgaggcgagaggattgcttaagcctgggcagttgaggctgcagtgagccatgatcgtgccactgcactgcacctagtttgaatggagtgggagtgggggattaggctctcctccctgccgtttgctcccaggccttttccgtagctggatgtgaccaacagagacagtgcccagcctcagtatagctagctcttagtggagggacaggagccatctggggcagatgtgggagagaatgtggcgaaggagagccgggtgcagtcaaggaggcttgtggctcggaggggaggtggggtgagtgagtggagactcagcagcttggctttggggaagtagacaagagagggccctctttggagagcggagcaagccaggatgtctggccttcacttccacttggaacagaagtgtgctgtgtgcgcgtgcttgtgcgtgtgcgtgcacgtgtgtgcgcgctaaatcaaacaccctcgctggctctgtgttcccctcaaggggaagccaactccacggatggcgggggtccattaggctgcaggtcttctccctgccgatagatggcgctgttgcaccgcgcctgggtttgcctctgcccgcagccatgcagggcccatcacgggctatgcctaccgcgcgaggggccttcaccatgtccactatccttatttatttatttatttatttatttatttattttttaagtgtgggtactggccgggcgcggtggctcacgcctgtaatcccagcactttgggaggccgaggcgggcggatcacgaagtcaggagattgagaccatcccagctaacacggtgaaaccccgtctctactaaaaacacaaaaaaattagccaggcgtggtggtgggcgcctgtagtcccagctactcgggaggctggggcaggagaatggcgtgaacccgggaggcggagcttgccgtgagccgagatcgcgccactgcaacagaacgagactatctccaaaaaaaaaaaaaaagtgtgggtatatagtaggtgtatatatttatggggtgcacattgataaaggcatgcaatgcataataatcacatcatgggctagatgcggtggctgacgccgagatcgcgcctctgcagtcgccaggccactgcaggcgccacagtggcgacagagcgagactccgtctcaaaaaaacaaataaataaataaatcaggttaggccgggcgcagtggctcacgcctgtaatcccagcacttgggaggcggaggcgggcgaatcacgaggtcaggagttccagaccagcctggccaacatggtgaaaccccgtctatactaaaaatacaaaatttagccgggtatggtggcaggcgcctgtaaccccagccactcgggaggctgaggcaggcgaatcgcttgaatccggaaggcggaggttgaagcgagccgagatcactccattgcactccagcctgggcaacaagagtgagattctgtctcaaaaaaaaaaaaaaaaaattacatcatagagaatggggtgtccatcccctcaagcatttatcctttctgttacaatccaattgcattcttttagttatttcgaaatgtacagttattattgactgtagtcaccctgttgtgctagcaaatagtaggtcttattcattctttctattttttttgtacccattaaccttccccacctccccatcatccttttttttgttttgagacggagtcttgctctgtcacccaggctggagtgcagtggcacgatctcagctcacttcaacctctgcctcctgggttcaagcgattctcctgcttcagcctcccgagtggctaggattacaggcctgcgccactatacttggctcatttttttcggggttttgccatgttggccaggctggtcttgaactcctgacctcaggtgatccacctgcctcagcctcccaaagtgctgggattacaagcatgagccactgtacccagccccatcatcctcattttatttattttttatttttattactatttttttaggtggagtcttgctctgtcacccaggctggagtgcagtggcgtgacctcggctcactgcaacctctgcttcccgggttcaagcaattctcttgcctcagcctcccgagtagctgggattgcaggcgcctgccaccacgcccggctaatttttgtatttttagtagagacaggagggttttaccattttggctaggctggtctcaaactcctgacctcaggtgatcctcccgccttggcctcccaaagtgctgggattacaggcgtgagccaccgcgcctggccagactgattttttttttaagtgaatttgaaagctgcaactggtgagtattggataaacaaactgtgatgggattgcaggtgtccacccccaagcctggctaatttttgtatttttagtagagaccatgttggccaggctggccttgaacccctgacctcaagtgatctgcctgccccagcctcccaaagtgtttgggattacagtcgtgagccaccgcacccggtcagaagtttaatttttttttttgagacggagtcttactctgtcaccccggctggagtgcagtggcctgatctcggctcactgcaagctccacctcccaggttcacgccattctcctgcctcagcctctggagtcgctgggactacaggcgcccgccaccaagcctggctaattttttcgtatttttagtagagacggggtttcaccatattagccagaatggtctcgatctcctgacctcgtgatccgcccgcctcggcctctcaaagtactgggattacaggcgtgagccaccgcgcccggcccagaagtttaaatttaactaggtgcccagtgatctcatcaagcccacagcactccctcaccctcgcccccacaacctcccttccccccacgccccccttcctcaccgcagtcccccccctgggacccctagatcttgaggctgatgggccagttcccagtttcactggttgttaaatattttgacagtgacccctgacagcaggagaggcagccaaactcaacagctgttctctcttccccccaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggtgctggtcctgcctgtccctggtccaaccccaccctcagcacacccctcccctcccctcccctctccagagcctccagccatgaccgggtgaacagccatggcctggagtcagcaacacaagactcttcccacctcagctcctccatctgagctgggctcagttgagctcatccagctaagctaaaggggagctgggcctgcttttctttttctggagatggggcctcagtctctccagtagctggatatacaggcatgctccaccccactggctaatttttgctttttttttttttttttttttttgagatggagtctcactctttcacccaggctggagtgaagtgatgcaatctcggctcactggaacctctgcctcctgggttcaagcaattctcctgcctccgcctcccgagtagctgggattacaggcgccagccaccatgcccggctaatttttgtattttttagtagagacagggattcaccatgttggccagactggtctcaaactcctgacctcaggtgatccacccacctcggcctcccaaagtgctgggattacaggagtgagccactgcacccagctgccttttttttttttttttttttttttgagatggggtctcactatgttgcccaggctggtctcaaacttctggactcaagtgatcctcccaccttggccacccaaagtgctgggattataggcataagccaccatgcctggttttggaattggttctttatctttgttctgctgctgcgtggcgtgatgttcaagagcaaaggacaacacaggggaagccagtgtcactggcaccacagccttgagcccatctctctagccctctgcaccttatttcccatctgtgaaatgcccttaaacaccccttctaattttaatattctgagtcaaattgagctcaggtccaaatgccaaatattgctgatattcatccactttttgacccacaaaagtggtcattttaacctacaataaaacatcctggctcagtggctcatacctgtaatcccagcactttgggaggcccagttggggggattacttaagtccaggagtctgagaccagcctgggccatatagcaagattctgtctctacaaaaaattaaaaaattagccatgcttgtgggcaagcccctgtagtcccagccacttgggaggctgaggtgggaggatcacttgatcccaggaggtggaggctgcagtgaactatgactgcactgaactccagcctgggcgacagagcgggaccctgactcaaaaacaaaacagtggccaggtgcggtggctcacgcctgtaatcccagcactttgggaggctgagatgggtggatcacgaggtcatgagttagagaccatcctggccaccatggtgaaacgtcgtctctattaaaaatacaaaaattagctgggcatggtggcacgcacctgtagtcccagctactcgggagactgaggtgggagaatcacttgatcccaggaggtagaggctgcagtgagctatcattgcaccactgcactccagcctgggcgacaggttgagaccctgtctcaaaaacaaaacaaagcaaaaacaaccccaaagtctggtttccttattaaccccaagttcatggtccacccgaagcttttcaaatgtcagtcccggctccccgcgccccagctgcagtgctgggccctatcgtcaccctcgccctcccggctccctgcgccccagtgccaggtgctgggcccagtcctcacccttgtcctcccggctgcccagcaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggtaaggtgggctctgcctccggggagggatctgtggtgggctcttacctccccttggcttgtgtcccgcaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaagaaagagagaaagagagagggagggagggagggagggaaaggaaggatggaaagaaaggaagaaaggcaggcaaaagccccagacaggccaaaaccttcatccttcatgcacccaacctgtaccaaacaccagcatggcctggctgtgagtgcacagcagatggaggtttgctgggcagagacactgggctggcctagacactgcctttggtgataccctaaaccaaaggggccagtcccacagtaagaaggagaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttctttaatccggtgcctgaggagttttgtctgtggctcgtcctgctacaagaggacacagcccagaggtgccacctgcagctgccctgtcccctctaatcccagctccaccctgcctgctcccgtccttcctccagggggaacatggacacgctcagatgaaccccagcttcttatgcctgaactggggaaactgaagccccatgggaccaggggttccactgggcatcaagggaggaaagttgagccccggggtgatctgggaactgggatctgggatctgggcaggcattggggcctgacagagcagaagtgaggagagggtaccaggagctgcaaactcggtgcctccaggacctattcggataaaataaatgggtggaactggaataagacaaagtgggggtgcgctgtggccaactggaaaatgctcgttgcagccacagcgttccattaaaaaagcgaaaggaacctgcctgcctgagtcttaagctccccctaaacccagaaatgggttagccctccagtatcctccagctctgagagctggggcgggcactccattactgggggaacaggaaatggatcctgggcactctagggcaacacacgccctccttgcagggaaatggatttccaggcaggggagatgcatgggcagaggtggcttggattgtttgctgtaagatttgaagctgtgatcaggaggtggctaggagatgggctgggtccagaccacaaaatggtagatcggaggatttggactctgtctcatgagtgagctggaaatcaagctggaaaatcagataagcttattcgcagcttcaatccagtccgttgcagaaggatgcatttgagggggctagagcagctgcagggaggccaggaggagctgtggaagaggacttgagtgtgggtcatggccatggggtttggagagaagtgatacagtgtcttcagagcttcagaaggcagagggagttcgatggctcaaggcagttggaagagttgggtgtgactgagggggtggggaaatggggcatgcgtggcaggcaaggactcttatgcatcacctcccagtcccttgtccatctggctacacttcctctttgcctggccagcctaggaccaagctgggatcatttccccaggatgccccacagacaatggcaaatgtgcccatcatagcagtttgtttaatgaaaatgatatgctgttgtgagtacgggatgtgccagcaatgctggctactgcatgagacgggagctagcagggagcaccttcatccagggtgtgcaggtccccttccctcagttaatgctcgtgggggcgggcgttagcctctccacttaccgaagaggagactgaggctttataaagttaagagagctgcttagggtcactcatcaataaagtggtggaggccagtcatggtggctcacacctgtaatctcagcactttgggaggctgaggcaggaggatcacttgagcccaggagttcaagaccagcctgggcaacatagtgagactcaatttctatttttaaaaaattatccagctgtggtggtgcacacctgtagtcccagctactcaggagactggggtgagaggatcgcttaagcctgggcagttgaggctgcagtgagctgtgactgcaccactgcactccagcctgggtgacagaggccctgtctcaaacaaaaataaataaataaataaatatataaagtggtggagcagtttgaattgtgtcattcactcattcaatatttaactgagcatctactgtgtgccaggcactattctagacaatgaacatacaacgagtaaacagataaaaatctctgtcctcagggagtctgtatgttggggttggggtgggggcggggaagaatagacaatgaaaaaatacttaaggaaaatatgtagacaccaattgtcctgatggccacccctgatggccaccagagggcactgcaaccacgcggccctccgttcgtctctaattccagctccctttccggattccgaaggcaatagccaaggaggctatgaatacgcagcatagcatctgctcaagaatcaacgcgaggaggcattggcagcagttttttctccacccacttttccagcctcatcccctcatcagacccccatccaactgcccagggtacccctgtgacttttcaaagccccgtgtactccagattcaccagctactcacattcactcccagccacccatcccctcccaaatactgtctgggttacccaccaaccccatccatccgctcacctgatgcctgtcctcctcctcacccacccacccgcgcccctcgccccttccacctgctgtcctgcccaccggaaactggccaaattgtcccatagatttttttttttttttttttttttttggataaacacagaaattgacattcctggtcttaaagcttgaaacttaaatttgccttatctgagttccttccccaggaaactgaccctcaggcctcccagatagcatcaaggaactgaaactccttttctttacccccctctaattcctgttttcccacccacagctacatttgctccccactatataaacccccaattggagtttgttggagagatggatttgagacttatctcctgtctccttggcagatgtcatctgaataaagccttctttcctggcgatactcattgtcccgggatcccagatcagctttctgtgcagtaagcaatgggacctagactgaatccctggcgtttcggtaatacacccatccatcctgtccacccccacccatcctgtccacccccatctatcctgtccacccccgacccatcctgtccacccccgacccatcctatccacccccttgtgcttccatccactcatcactcttcccacccctccgcccacccaccatccgatgctacagaagcccagaactggggcactcaatctagaggtcaaagatggcaagaggtcaaaccagattgacagtgagtcacctcagtggatatgagttttagtgtgctgaggccgtgaaaggtaaaagcatttaaaaacagcaaggccaggcacggtggctcacgcctgtaatcccagcactctgggaggccaaggcaggtggatcacctgaggtcaggagttcaaagctagcctgaccaacatggggaaatcccttctctactaaaaatacaaacttagctgggcgtggtggcatgtgcctgtagtaccagctactgctacttgggaggctgaggcaggagaatcgctgaacccgggaggcggaggtttccatgagccgagatcacaccactgcactccaccccggggaacaagatcgaaactctgtctcaaaaaacaaaaacaaaaaacccacaaaaattagccaggcgtagtggcgggtgcctgtaacccagctacgcaggaagctgaggcacaagaatcacttgaacctcaaaggcagaggttgcagtgagccgagatcatgccactgcactccagcctgggcgacagagtgagactctgtcccaaaaaaaacccagagcaaacaaacaaaaaacacaacggcgagacattcttagcaaaccaactatctgcaaacaattcaacgtcggatctttaaaaaaatcccgctgtggcattatgctgcggacacatacattaatttatggctagcccttcaagacaaccaggtgggtaaaattatgtaaatgttcaccgcctctatactttgttccaatgacttcctgagtaattgattgttttgccaattactcagcaacatttaagacctgcttccggaggccctaagtagctcagcattctaagaccgaagtactgaagaaaatctgcctgtgtggctgtgaataacatctccatccgtcactgtgcacatcagatttaggccagataacgcaggctttatttatttcaggtacgccttgcgcttcagatcatgggactctagtatagcacccccagaaaattatcaagggcaaaaaaatcataatacatacctctagttcagtgggtccttggataacctctttcctctctcctagttcttcagctaaaagattcaggagccttagcaacaagaaggagctatcccacaagttgcattattctagatattcggacacttttttttttttttaagcaggagtcttgctatgttgcacaggctggtcctgaactcctgtccttaagtgattctcttgccttggccttccaagtaactgggattacagcggtgagccaccgtgccagggttttggatgctttttttttttttttttgagacagagtctctcttgtcgccctggctggagtgcaatggtgtgatcttggctcactgcaacctctgcctcccgggttcaaacaattcttctcccttggcctcccaagtagctgggattacaggtgcgtgccactacactcagctaatttttgtatttctagtagagatggggttttaccatgttggccaggctggtctcgtactcctgatctcaggtgatccgcccaccacagcctcccaaagtactggggttacaagcgtgagccatcgcgcctggccggatactttttaaccaaaggaaaaagcaagcatctttattggaataatatatcaatatatgcaggtaatcagacaataccagtcagacaacactgacttctttttttttttttttgagaaaggaaggaaggaaggcagaaaggaaggaaggaaggagggaaggccggaggtggtggctcatacttataatcccagcactttttgaagcccagaagggagatcacttgaggccaggagtttgagaccagcctgggcaatatagagagaccccatcttgacaaaaaatttaaaaattagccaggcatgataatttgcacctgtagttccagctacccaggaggctgaggcaggagaattgctggagcccaggagtttgaggctgcaaccagccgtgactgcaccactgcactccagcctgggcgacagagagataccctgtctcgaaaataataaataaaggccgagtgtggtggctcacacctgtcatcccagcactttgggaggccgaggcaggcagatcacctgaagtcaggacttcaagaccagcctggccataatggtgaaaccccgtctctactaaaaatacaaaaattagccaggcatgatggcaggcgcctgtaatcccagctacttgggaggccaagacaggagaatcgcttgaacccgggaggcggaggttgcagtgagccaaggtcgtgccattgcactccagcctggagaacaacagcgagacttcgtctcaaaataataataaataaataaataaataaatatgtaaaaagtcccttaactgaggccaggcgcagtggctcatgcctgtaatcccaacacttcgggaagccaaggagggtggatcacctgaggtcaggagttcaagaccagcctgaccaacatggagaaaccccatctctactaaaaatacaaaattagctgggtgtggtggcgcatgcctgtaatcccagctactcaggaggctgagagaggagaatcgcttgaaccctggaggtggaggttgctgtgagccaagatcacaccattgcactccagcctgggcaacaagagcaaaacttcatctcaaaaaagccccttaactataatctaagaaacaaaaaatatttaatttttattttctgcatgatctgcttagttttcttaataagctgtgaaccagaaagggaatttgctgcggtttggcagccttttaggtggaggattatagtgaatacatttttagattattggtatagtaacttccccaaaggatgtaagattttgaggactaaaccaagtcctgcactttccattccaacctaattaattccagtgaatgaaacattcattggggaaagcacagaagatgcagaagagctgcttacatgacctgagtcaacaattcagtgaccctctgcgtataataatcaaaatagggccaggcgcagtggctcacacctgtaatcccagcactttgggaggccgaggagggcagatcacctgaggtcaggaatttgagaccagcctggtgaaaatggtgaaaccccgtttctactaaaaatacaaacaattagctaggcgtagtggcgcacacctgtaatcccggctactcgagaggctgaggcaggagaatcgcttgaacccaggaggcagaggtcgcagtgagtcgagatcgcgccattgcactccagcttgggcaccaagagtgaaactcggtctcaaaaaaataaataaataaaaataaaaatagaacaataaagtccattcataaattttctagcatagttaacttatccacctcctcttgcttttcgttaattaatttagttatcagagtacaaaatgaaaaagtaaaaaatatccattcactctcattcccatgaggtaaccacgtttaaggagctctgtgtttttagtcctcctggcatctacacttgagtggaaaagatgatcatttgtggttttaagcactattgactccctgatgtgaagaacaaagaatgtatctcactcattctttttttcttctttttttttgtgctgtttttattggtagtcttcctactagttatcatcataactttaaatgatatatttaatccccttttcttgaagcattgtttttatttttatttttttacttgtatttatttatttattgagacagagtctcactgtgtcacccaggctggagggcagaggtgtgatcttggctcactgcaacctccgcctcctgggttcaggcagttctcccccttcagcctcccgagtagctgggattacaggcacccgccaccatgcccaactaatttttgtatttttagtagaggtggggtttcatcatgtcggccaggctagtttcaaactcctgatctcaaatgatccacccaccttggccttccaaagtgctgggactggccggggatgatggctcacgcctgtaatcccagcactttgggaggctgaggcgggtggaaatcacaaggtcaggagatccagaccatcctggctaacacggtgaaaccccttctctactaaaaatacaaaaaattagccaggcgtggtggtgcatgcctgtaatcccaggtacttgggaggctgatgcaggagaatcgcttgaacctggaaggcggaggttgcagtgagccgagatggtgccactgtactccagcctggacgacagagtgagactccatctcaaaaaaaaaaaaagcaaaaaactccacaaagtgctgggattacaggcgtgagccactgcgcctggcctgaagcatcgtttttaaaattcagatataatttacatcgcatatacttcactgctttaaagggttcaggctgggcacagtggttgacacttgtaatcccagccctttgagaggctgaggtgggggggatcactcaaggccaggaatttttgagaccagcctgggcaacatagtgagactcgctctctaccaaaaaatttaaaaatgagctgggcaagatggcacacacctgtggttccagctacttgggacgctgaggtaagaggattgcttgaggccagaagctcgaggcagcagcgagctgtgattgcaccactgcactccaacctgggaaacagagtaagaccccttctttttttttttttagatggagtctcgctctgtcgcccaggctggagtgcaatggcgcagtctaggctcactgcaacctccacctcccaggttcaagcgattctcctgcctcagcctcctgagtagctgggactataggcgcccaccaccacgcccagctaattttttgtattttcagtagagacggggtttcaccacattggccaggctggtctcgaactgctgacctcatgatctgcctgcctcagcctcccaaagtgttgggattacaggcatgagccaccactcctggccaaaaccccttcttaaaaaaaaaaaaaaaaaaaaaaaaaaagaacatccttttttttttttttttttttgagacagagtttcgctctcttgcccaggctggagtgcagtggcgcaatctcggctcacctcctgggttcacgccattctcctgcctccatctcccgagtagctgggactacaggcacctgccaccacgcctggctaattttttttgtatttttagtagagatggggtttcaccgtgttagccaggatggtgtcgatctcctgacctcgtgatccgcacgcctcggcctcccaaagtgctggaattacaggcgtaagccaccgttcccggccaaaagaacatcttaataatcccagaaagattgggcgcagtggctcatgcctgtaatcccaacactttgggaggttgaggcaggtggaccacgaggtcaggtgttcgagactagcctgaccaacacggtaaaaccccatctctactgaaaacacaaaaattagccaggcatggtgatgcatgcctgtaattccagctactcaggaggctgaggcaggagaattgcttgaacctgggaggcggaggttacagtgagctgagactgtgccattgcactccagccagggtgacagagtgagactctgtctcaaaataaataaataaataaataaataaataaataaataaaataactccagaaagaaactcccttcttgtgatatcaagtacatctccctcctctcagccaatggcaaccattattctactttctgtcttgatggattttatctacatagaattgagggaagagagaacttctcatattgttttatattgttttatactcagtacctgttttaagaaaaaacaacaagaaagtaaaatcaaagacaggcagcccggcgccaggcccgaaaccaggcctgggcctgcctggcctaaacccagtagttaaaaatcaactcataacttagaaaccaatgttattcatagattgcagacactgtatagaagaacactgtgaaactccctgccctgttctgtttctctctgaccaccggtgcatgcagcccctgccacataccgcctgcttgctcaaatcaatcacgaccctttcatgtgaaatctttagtgttgtgagcccttaaaagggacagaaattgtgcattctgggagctcggattttaaggcagttgcttgctgatgctcccagctgaataaagcctttccttctacaacttggtgtctgagaggttttgtctgcggctcgttctgctacagaagcatacaacacatggccttttgtgcctggcttcttccattcagcatgtttctgagggtcatccatgttgtctgtacttcattccttttaatggtttccattgcatggatatactacattttctttacccatgcttcagttgatggacatgtgggttgtttctacgttttggctattatgaattatgctgctatgaaaattcatgtactggttttggtgtgggcacacgttttcaatttctcttgggtgtatacctaggaatagaattagaaaatcatgttggctgggtgcggtggctcacgcccgtaatcccagcactttgggaggccaaggcgggcggatcacgaggtcaggagatagagaccatcctggctaacacggtgaaaccccgtctctactaaaaatacaaaaaattagccaggcgtggtggtaggcgcctgtagtcccagctactcgggagactgaggcaggagaatggagtgaacccgggaggcggagcttgcagtgagcagagattgcgccactgcactccagcctgggcaacagagcgagactccgtctcaaaaaaaaaagtcatgttttactttttgtggaactgccacactggttttcaaagctgctgcttgtacattccactagcaatgcacaagggttcctatgtctccacatccttgtcaacacttgttattgtccatctttttaattatagccatcctagtgagtgtgatgcagtacctaattgtggttttgatctgtattttcctaatgattgatgatgttgaacatcttttcatgtacttatagaagttattaaaaaattactttaggcagatggagaggaaaaggggtccttggaaagttgtttcttttaaagcaactccagaaacgtttctggtttaccaggaaagccctggctcttagagcccagccagcaacatttgatatgcaaatgcagaccattagaaactgggtccacccaaacatggcgattcccaccgttgtcctcttgcccttgcccccacatgtgcctggcaaatggctacccctacatatcccccacctgtgtaaaacatcatggtgccctgcatttgcatcttaaaaggctagggtgagagggccagttttttcgtgggctatatgaatgacatgcctggttaaaccaatcccctaagccctatgcaaattagacaacacctcctccagcctcctcatatacccggttggtatgccccgcatttgtggtctcctctcttggctttggagcccccctccctctgtctctgtacgggggtgccttcttcttttcttcttctcccttctttcttgcctattaaactctccacttcttaataccactacacgtgtatctgtgtcattttatccaatttgcatgagacaagagccctggtgcccctccactcatcagagccgtatcattttggtgcatgggccaggaaaatccaaagtacagccttcgttggagtggtgagtatgggagcaatcctaaaatctgttctatcattacgaggcgctcttagcctctatattaaaataaatcaaacgggcgtccgtcagcctaatacataggcttagcattggctgccgtactaaagactcggatgtgaggcttgctggggagaacttggagaatcccccattacccacaggtactgggaattttggccatgtttgaactagcttctttttgttagggataacgctcaaaatcctaaggaaattgaacactcgaacaaaggattcttagcaaagcaattttacttctgcacagagggttgcctccttggccagttgccatgagagcacacctgaacaaaggggcatgagagcctttatttgcgatggaagtcctgcccctgtaccctttcctcattggctggggttgggtcatacaatctaaactaatcccggttggctaaacatttcattttttaagatagggtgggcacgtaaaaacaagtggagaggaaggggaaggggtgtctgtaatgagctagaaagttagtcatttttccaaataaggaaaggaatgtgagctggtactgataacgcttggtactgtggtgtgcctgggcatctaacaaaggcaaaatggaaaaggagaaagaaggagaaaaaagggggggggtacaatgaattaaagaatgaaagattgatgagattatttgaagagaaacctcatcatattccacattttcacagggagaccttgccatcatgcgaggctgggaaaacttctgaggtaactgagaatttctggtcagggcacactctggcatgattcaagggcctctggaccggacgcagcctccgacagccgggtgttggcagagaatcctcaactatcctgtggccaaattttctttctgtctctatccatggtctcttaccctctctgtgtgtctaatgtgcagggatctttacagttcagggaaacaggtctgctagaagagatggtgaatcacggcagccagtaactcaataaacgtttctctatggtttctctggtgagcacgtggtatttctaagccacctagtggcaataaaaatcctcttcatgagacacattgctggttctctacggtacattgcagcttcgcaatttttctattttgcgcttttttactgctatttctgtgaacgggaaggctctgcttttaacaggagtcaaatgtcttctgcagccagattttagtcctaatattgtcccatcagtagaaattggccatttgcttcctacgttcttttaaggcacctattctgtctccagttaagatagtacttaattagtagggaaattttaagtctggaagttaaccggaaccattttcctatgggtaaatgttttatcataggccataatagcaggatttagagttcaatctagcatgccccctgccttaaaggggtcttgcccaattacatgatttttcttgaaatccatttttttaggaaggcacaaaggccacacaagtctggaaggtcaaagagaaataaaaggcagaggactaaggctgcttggggaaagcgtgactaaggctcaaaagttgagttcctctgatgtcatggcttggagggtcacgcctgcagtcacaggtcactggtggcccatttaaataggtgctgggaatccagaaaccacggagagaagatagttgggggaactccccctactgcttttgtctccaacctggatcacataccaaaaggaaggagactaaaagaacgcttttattctcacttctctttctagatgggaattagatcatgtataacatgcactgccctcgagtgtattttaaagcactgggactccttcaactctgaaactttgaagaaaaagtggcttattttcttttacacaagggcatggcgtatttgtttttgttttttttttgttttttttgtttttttttttttgagacggagtcctgctccgtcactcaggctggagtgcagtggctcgatttcggctcactgcaagctccacctcccgggttcacaccattctcatgcctcagcctcccgagtagctgggactacaggcgcccgccaccacgcccggctaactttttttgtatatttaatagagacggggtttcactgtgttagccgggatggtctcaatctcctgacctcgtgatccacccatctaggcctcccaaagtgctgggattacaggcctgagccactgcccccggctgggcgtggcctttttactaaacttctgcaagcgttgcaaaatcaacctagctcttttagcaatcacatcaggcaggcccaaagagaatgattacccaaaattagagaagccagttctaggggaaccacctgaggattcctttatttggggccccttcaagttcctttctcattatttaggaccttaggcaagtaaagggagacttaggccaattttctttctttctttatttttttttgaaacatagttttgctcttgttgcccaggctagagtgcaatggcgtgatcttgactcactgcaacctccacctcccgggttcaagcaattctcctgcctcagtctcccaagtagctaggattcacaggcgtgcatcaccatgcccagctaattttatgtttgtttgtttttttagtagagacagtttcaccatgttggtttggctggtcttgaactcctgacctcagatgatccacccgcctcagcctcccaaagtgctgggattacaggcgtgagccactgcgcctgtccaatcttctaatgaccctgataggtatacagaagttttccacaatttaactcaggtatttaacctctcatggaggaatgttatgctgctcttaagccaaaccctaactgcagttaaaacaggcagctctgcaagcagaagaaaattttggagataagcaataggtctcctatagtaggccaaaagggaaaagaaaaaatagggaaggcaaagaaataggggaaacaatatttccaataggaaaagaggcaatacctcttggcaaccctatttgtcactcctttctatggtgtttttccttctttcacggtttaaaatggcttctatctcttttataatgttcttccaacctgggaaaagttatttttccaaacgttaaaatgcttggcttagagttgagctagggggaagggaacacagaagcctggtatgctggcaaaagggtaaacatttcttaccagatgggcttttggcttctccctgtgcaaaccggtaaaagggataataaggatcattgtttatattctctgtaaatttctaattcataaaaaaggatttgtgaggttggtcttaagctgtaaacaatctggtgtgctttgcatgtctttccctaagaaagggtatcttaggttaggatgcaggcctaggaccccataagcctggtgtttgagcgagcccaacaaaatcgtcactaacaaaattggctataagccttcatcttgtttcatgtccttggaaacatgacctgtaaccacgtggcaatactttgtttgagtctccaccatttcataatggtggctgtcttctggtgctaagtcagtttctgggtgagggccacaaaatcagattaagtcggtttgtcaatctgggtggtgccagctgatccatcaagggcagggtttacaaaatatcttaaacactcattttaagagtagtttagggagtgtcaaaatcttgtagcctccagatgcatagctcctaagccatagtttccaatatatatatataattttatattatatatatacataattttatattatatatattaatatataatatatataattatatatgttaatatatttaatatataattatataaaatatataatatataattatatatgttaatatatttaatatataattatataaaatatattaatatatataattatatagttaatatatttaatatataattatataaaatatataattatatataattatataaaatatataaatatatataattatataaaatatataattatatataattatataaaatatataattatatataattatataaaatatataattatatataattatataaaatatataaatatatataattatataaaatatataaatatataattatataaaatatataaatatataattatataaaatatataaatatataattatataaaatatataaatatataattatataaaatatataaatatatataattatatataattatataaaatatataaatatatataattatataaaatatataaatatatatatatatatattttttttttgagatggagtcttgcactgttgcccagggtggagtgcagtggcgcaatctcagcttgctgcaacctccacctcccaggttcaagtgattctctttgcctcagcctcacaagtagctgggattacaggcgtgtaccactacacctggctaacttttgtattttcagtaaagacagggtttcactatgttgaccaggctggtttcgaactcctgacctcgtgattcgcccaccttggcctcccaaagtgctgggattacaggcgtgagccaccacgcccagcctggtttttaatcttatggctagtttcttggtctggtccccagacaagagggaagtatatcttaagaaggggctgatatcatctttgttttaaactatctatagtttaataactataaactatctatagtttaataactataaactatagcttaataactataaactatagtttaataactataaactatagtttaataactataaactagtttaataactataaactatagtttaataactataaactatctatagtttaataactataaactatctatagtttaataactataaactatctatagtttaataactataaactatagtttaataactgtagttttaaactatctatagtttaataactataaactgtctatagtttaataactgtaaactcgcccctcccaaagttggtccagcctacacccagggatgggcaaggacagcttgggggctggaaacaaaatggagttgtttgggtcggatctcttctctttcactgtctcagtctcagttttgcaatgacagtttcaaaagctgcctattactcctttgaaaataccttgtacacttgtggataagtcataacctaattaaggctcattgggttcacctgtgaggttactttttgtaaaactcaaaagccaaaaatcttaactgcttggcatggctaaagtcaagtaacaagggattttgaaggcttttcttagagcactcagcttaattaaaagtggatattcaagttataggtatacttaaaaggcctttatgtttttctcttcttgaatcttgttttctggaaaaaggctcttctcagtcaactgaattatttttctccatttttgtcttaaccactcttaatgcatgcatgagagtccctaagacaacttctgacagcatggaactccttgggaaaaacagaggaggtgccacaaaccctgttttggaaaaaaaacctgttttcctcatgaaacccccaaaattaaaagctgatagttccctctcaaaaccaaaggctctgttctgttatgtattgtgttatctaccgttttgagttttgggggtatcaaattacttcacattataaaagagctttgatgtgtaataactaggtagaaaatacactgtaaaggatgcctaatagtagttataaatcaaaaaagcatgctcttgggcacctaaaaaacatccccaccccccacaaagagatgagactaccatgcagaatgggctaattgccaaaataagccaattggctttgggttgccttgcaatgaaatgcatggtagaaacactacactgtcttctctcatagtatctatatggtcttttcataaattgagcattgaaataaaagcatagcaaggagttcctaaaacactaatctgtcctttggtaaaaaggttataaaagatttgtaaagatttaactgtaactgtcctggaaattttgtcattcgcaaacaattgttgtcttgcttcgttccttctcagaaaatggtttataatcaagctatattaaggactttaacaggtgttctcaaatgcaggtttttaatagctttgaagattgtaacattggaataaaaaagtacaggactcataaagaatggacatattcacaaatatcaagcaaaacaaaagttaactaaatggactgcactcaaaaagttaaagcagcttttttttttttttttgtgatagagtctcactctgtcacccaggctggagtgcaatggtgcaatcttggctcactgcaacctccgcctccctggttcaagggattctcctgcctcagcctgggattacaggcgcccaccactgcgcttgacaaatttttgtatttttagtagagacagggtctcaaactcctgacctcatgatccacacgcctcagcctcccaaagtgctgggattacaggtgtgagctgccgcacctggccaaagcaacctttttaacttttgcttggaatattgcaaatacgcatgagagtccctaagataacttaaggatccttgttttgtctttcagagtcaagaaaacttattttgaactatttacagcctttaataattaagtaaggtgccgggcaccgtggctcatgcctgcaaacccagtactttaggaggctaaggagggtggatcacctgaggttgggagtttaagaccagcctgaccaacttggagaaaccccatctctactaaaaatacaaaattagctgggtgtggtggtgcatgcctgtaatcccagatactcgggaagctaaggcaggagaattgcttgaacccaggaggtggaggttgcagagccaagatcacaccattgcactccagcctggcaacaagagcgaaactctgtctcaaaataaaataaaataaataattgcgtaaggtatatgcctgtgaacaaaatttggagcatgtttgtttttctctgcctggttcctctagaacgtggagactatctgtgagtactcttaacttatggcagtaaggttgtttgcatcagtgcaataagagtcaattttctggccgggtgccgtggctcacgcctgtaatcctagcactttgggaggccgaggtgggcagatcacaaggtcaggagatcgagaccatcctggttaacacggtgaaaccccgtctctactaaaaatacaaaaaaattagccaggtgtggtggcggtgcctgtagtcccagctactcaggaggctgaggcaggagaatggcgtgaacccgggaggcggagcttgcagtgagccgagatcgtgccactgcactccagcctaggcaacagagcaagactccgtctcaaaaaaaaaaaaaaaagagtcaattttctttgtcaacaggacacagttggaaaaactggttattttaccaaggtttcactgaaagggtgtgtttccctttaaggaatcaagcttgacatgcagacccaataaaaaccccttggagagaactggcctcatagttagtctacacagtccccacacagggttcctaacctatggtcagtaaagagtgtcactttctaacaggcctgggagctccaagtttatcttggaaccttaagaggagaggatcacccaactcacaggtatttgaggatacaaacccatagttgggctcggctttaaaggtcttatctgaaattccttgtgcaacaaagtttcatcaaagccaattcaaaaggcctgtgtagaaataaccattcctggccgggcacggtggctcatgcctgtaatcgcagcactttgggaagccaagctgggcaggtggatcacctgaggttgggagttcgagaccagcctgaccaatatggagaaatcctggactcttctaaaaatacaaaattagctgagcgtggcagtgcatgtctgtgaccccagctactcgggaggctgaggcaagagaacagcttgaacctgggaggcagaggttgcggtgagccaagattgccctgttgcactccagcctgggcaaatcatcaggccaagtataaaactaaagtttattctacaaacaacacacatggtcctatcataatttgtttttaccaaaaatgagacctggagaaattgtgtcccaaagcttatcatacatttgtcattaaatcctagtctcattaattgtttttaagctttttgcctacattttagactaaccctgtttattcctgtaaatcaagtggtgatctgcagcttggaagaaaaaaaaaggaatggagaatgtaaaaatctgaatcaatatactggttctgggcaattatcctataaattctgccaggtaataaaagtgagtaggggccaggcgcggtggctcacccctgtaatcccagcactttgggaggccgaggtgggtggatgacctgaggtaggagtttcagaccagcctgggcaacatggtgaaaccccatctctactaaacatacaaaaaaattatctgggcatggtggtgtgtgcctataatcccagctactaggaaggctgaggcaggaggatagcttaaacacaggaggtggaggttgcagtgagccgagatcgcgctattgccctccagcctgggtgagaaggcgagactccgtctttaaaaaaaaaaaaaaagaaaagcagggcgcggtggctcacgcctgtaatcccagcactttgggaggccaaggcgggtggatcacgaggtcaggagatcgagaccatcctggctaacatggtgaaaccctgtctctactaaaaatacaaaaaaattagctgggcgtggtggcgggcacctgtagtcccagctacttgggaggctgaggcaggagaatggcgtgaacccaggaggtggagcttgcagtgagctgagatcgcgccacggcactccagcctgggcgaaagagcaagactccgtctcaaaaaaaaaaaaaagtgagtagggtgcccatagcttggagatttctttgtttgggaaaataaaacaaaagaacttcataaacccccaaagggaaattctatatcttggcaagtaaaattttaagtggaaattatctactacaccacacttgtgggaattgctgtactcaccccactattttcaatagggttatacacggtagcaccttaaagctgaaatattggacagagtttccattgccgtagtattctgcttattatccttatagcagggatagtagttactaacgaaaaggaagcataaaagttactatcaccgaatctgccaggactttttactgggtttagtgatgcacttttaaatgaaacatgctgcttctggattaaaacctctactaaagtagaggaaaatctacaggtacttaaagatgaaatcaaaatcattgacaggctcagagaaaatgccggcttcagccccgggtggctacaatccctctttaatgaattcctgtcttctttatggaattggttaacccctttattaagccctgtcttgtttatatgtcttgtataaatatttggaccctgtatactcaatactgtaactcaaattgtttcctcttgcttagaagccatctaactccaaatggtgcaaactgaacaacccaaggacatgcccccacatgtgcctggcaacgtggctgcccccacatatccccacctgtgtaaaacatcattgcaccctgcatttgcatattaaaaggctagggtgggagggccagttttttcaaaggctacacgaataaaatgcctggtcaaaccagttccctgagccctatgcaaatcagacaccgcctcctccagcctactcataactggctggtatcccccgcacttgtggtctcctctgttggctttggagcccctctccctctgtctctgtacaggggagcttcttccttctttctgctcccttttttcttgcctattaaactctccactccttaaaaccactccatgtgtgtccatgtggctttatccaattcccacggaacaggagccctggtgttcctccactcatagaagctttattacttatatatatattctatatatccatcatgcatcctacaaagtgaaagcaactttttttttttgagatggagtctcactatgtaacccaggctggagtgcaatggcacaatctcggctcactgcaacctctgcctcctaggttcaagtgattctcccacctcagcctcccgagtagctgggactacaggcgcatgcaaccacagccagctaaattttgtatttttagtagagatggggtttcaccatgttggccaggctggtctcgaactcccgacctcgtgatccacccacctcggcctcccaaagtgctgggattacaggtgtgagccacaaagcccggccaaagtaacttattaattctgataatttttccctccctccctccctccctcactttcttccttccttccttcgttttgttttggtttttgagatggagtcttgctctatcgcccaggctggagtgcagtggcatgatctcggctcactcaacctcttcctcccaggtgcaagcgattctcctgcctcagccacctgagtagacgggattacaggcgtgtgccaccacactcgtttttgtttgtttgtttgtttgtttgtttgttttttgagacagagtctcgctctgtctccccagctggagtgcagtggcacaatctaggctcactgccagctccacctcccgggttcaaatcattctcatgcctcagcctccccagtagctgggactacaggtgcccaccaccatgcccggctaatgttttgtatttttagtagagacaggatttcactgtgttagctaggatggtctcgatctcctgacctcgtgatccacccgcctcggcctcccaaagtgttggaattacaggcgtgagtcactgcgcccagcctacacacactttttttttttttttaattagctgggcctggctgagcacggtggctcatgcctgtaatcccagcactttgggaggccaaggcgggcggatcaactgaggttgggagttcaagaccagactgactaacatggagaaaccccgtctctgaaaatacaaaattagccgggcatggtggcgcatgcctgtaatcccagctactccagaggctgaggcaggagaatggcttgaacctgggaggcggaggttgctgtgagctgagatggcgccattgcactccagcctgggcaacaaaagtgaaactctgtctcaaaaaaaaaaaaaaaaaaattagctgtgcctgtagtcctagctactgtggaggctgaagcaggaggactggttgagcccagttcaaggacgcagtgagctatgattgcaccactgtactccagtctgggcaacagagtgagatgttatctaaaaaaacagagtacaattcagtggtttttagtatattcacaaagttgtgcaatctatgccactatccagacattttaatcaacccaaaacgaaactctatgccgaatagtcactgcccattcccctctcttccctagccctgccaaccactaatctgtagggaccagccccacagggtcggtgggtctctccctgtgtgcggcgacgagagagtgtagaaataaagacacagacaaagagataagagaaaaggcagctgggcccggggggaccactaccaccaatgcccggagaccggtagtggccccgaatgtctggctgcgctgttatttattggatacaaggcagaaggggcagggtaaagaatgtgagtcacctccaatgataggtaaggtcacgtgggtcatgtgtccaccggacagggggcccttccctgcctggcagccgaggcagagaaggagaggagacagagagaaagagagcttatgccattatttctgcatatcagggactatttgtattttcactaatttactactgctatctagaaggcagagccaggtgtacaggatggaacatgaaggcggactaggagtgtgaccactgaagcacagcatcacagggagacggttaggcctctggataactgcgggcgagcctgactaatgtcaggccctccacaagaggtggaggagcagagtcttttctaaactcccccggggaaagggagacccctccccccactttcccggtctgctaagtagtgggtgttttcccttgacacttacgctaccgatggaccacagtccgcctggcaacgggcgtctgtcttcccagacgctgtcgtcaccactagaccaaggagacctctggtggctctgtccgggcataacagaaggctcgcactcttgtcttctggtcacacttcgctatgtcccctcagctcctatctctgtatggcctggtttttcctaggctatgattatagagcgaagattattataatattggaataaaaagtaattgctacaaactaatgattaatgatattcatatataatcatatctaagatctatatctggtataactattcttgttttatattttattatactggaacagctcgtgtcctctgtctcttgcctcggcgcctgggtggcttgtcgcccacactaatccactctcttaacccccctccctttttttttttttttttaagagataggggtctcattataatgttgcctaggctggcttcaaactcctgggctcaagtgatcctcttgcctcaacctcccaactagctgacacacgccaccacatcaggctttttctttttttttttttttgggacagaatctcattctgttcacccaggctggagtgcagtgatggtgtgatctcggctgcaacctccacctcccaggttcaagcgattctcgtgcttcagcctcccaagtagctgggatcacaggcatgtgcgccaccatgcccggctaattttctgtttttagtagagacggggtttctccatgttggtcaggctggtctcgaactcctgacctcaggtgatccgcctaccttggcctcccaaagtgctgggattacaggtgtgagtcactgtgcctggcctaattcttgtatttttagtagagacaaggtttctccatgttgcccagactggtctcaaactcctggcctcaagtgatcagtccaccttggccttgcaaagtgcaggggttacaggcatgagccactgcactcggtctatttttttttttttttttttttttgtagagacaagggtcttgctgccaggcgcggtggctcacacctgtaatcccagcactttgggaggccgaggtgggtggatcacgaggtcaggagatcgagaccatcctggctaacacagtgaaaccccgtctctactaaaaaatacaaaaaattagccaggcgtggtggcaggcacctgtagtccccgctactggggaggctgaggcaggagaatggcgtgaacctgggaggccgagccagcagtgagccgagattgcaccactgtactccagcctgggcgacaaagtgagactccgtctccaaaaaaaaaaaaaaaaagaaaagaagagacaagggtcttgctatgtggcccaggctggtcttgaactcctcttatcttggcctcccagagcgctgggattacaaggatgagccaccgcacctagatgctggctactttaagattttcactttatcagtggctttgagcaatttgattatgatgtgctttggtgtagtttcttgtgttagagaattgttgagcttcttggatgtgtagatttatgattttcatcaaatttggaaactgttaagctattagtccttaaggtattttttctgtgcccctctatctctcctttccttcaactccaattactcacatattagcctgcataaagttattccacagctcactgatgtggttttctttttactttccagacagggtctcactctcacccaggctgcagtgccgtggcacaatcataactcactgcaaccttcacctcctaggctcaagaaatcctcccatctcagcctcctaagtagctgggactacgggtgcacaccatcacacctggctaattttttcttttttgtagatatggagtctagctatgttgcccaggttggtctcaaactcctggcctcaagtgatcttcatgccttgacctcccaaaatgttgggattacaggtgtgagctactgtgcccagccatgtttttcattcttaaaattgttttttctgcctggccctgtggctcacgcctataatcccagcacttcggggggctgaggtgggtggatcatttgaggtcaggtgttcaagaccagcctggccaacatggtgaaaccctgtctctactaaaaatacaaaaattagccgagtgtggtggcacatgcctataatcccagctacttgagaggctgggccaggagaatcgcttgaacccaggagtcagagattgcagtgagccgagaccttgcgccagtgcactccagcctgggagacaagagtgacactccgtcttaaaaaaaaattgtttttttttctgtgaggatcacttgagcccaggaggtcaaggctgcagtgagccgagatggtgccactgcaccccagccagagtgagaccctgtctcaaaaaaaaaaattgttttttctctgcgtttcattttggatttcttttgctatgatttcaacttcactaaggcttccttctgcaatatctaatctactatcaaccctatttattgtacttttcatctctgacattgtaatcttttagatgcttgacttgggcctttgttttgtatctccttatcgctacttaattttttaacatatggcattcagttatagtaactattttaatgttttctgctcattgtaacatttgtgtcagttctaggttggtttccattaactgattattcttcttaatatggtcatgttttctgcctctttgcctgcctggtaatcttttcttaaaagtggggagcttttaaaccaatctcatcttctgggttaaaaagaatttttttgccattgaagttcatcttcatattccaatttttaaaaagcattctataaattttaatcatgtacaattatggggtacaccatgctgttatgatatatagatacagcatagagtaattgaatcaagctaattaacacgtttatcatcttaaatactcatcattttttcctgtctagctgcaactttgtactctttgaccaaagtcactccgtttcctccccacctccagtttctgctaactaccattctactctctgcttctattagttcaattatttcagattacacatttaagtgagaacatgccagaatgcggtatttgtctttctgggcctagttcatttcactcagcataatgtcctccagcttcatccatgtagttgcaaatcacaggatttgcttcttgcttctttttaaagttgaatggtattctattcaaatgtgtatatatacacattttctttatcttttctgtcttttcatctcttttttttttttttttttttttttttgagacagagtcttgctctgtcacccaggctggagtgcagtgacttggtcttggctcactgcaacctccgcccctctgggttcaaccaattctcgtgcctcagcctcccaagtagctggaattacaggagtgcaccgtaccatgcccggctaatttttgtatttttattagagacagagtttcaccctgttggccagactggtctcaaactcctggcctcaggtgatctgcccgcctcagcctcccaaagtgctgggattatacacgtgagccaccacgtccagcctgttttttgtttgtttgttttttgtttttgagatggagtctcactctgtcagccaggctggaatgctgtggtgcaatctcggctcactgcagcctctgcctctcagcttcaagcgattctcttgcctcagcctcccaagtaactgggattacagacgcctgccaccatgcccagctaatttttgtatttttagtagagatgggggtttcaccatgttggtcaggctgctctcaaactccttacctcaagtaatctgcctgctttggtctcccaaagtgttgggattacaggcgtgagccacagcgcctggccacattttctttatcctttcatctgctgatggatgcttaggttgatgtcatgatttgcctgttgtaaataacactgcagtgaacctggaaatgcagatatctctgacacactgatttttcagttcctttggatatacacccagaagtgggattgctggatcatttggtaagtctacttttagttttttcgttttgttgttgttgttgttgttgttttaaatgagtctggctctatcacccaggctggagtgcagtggcactatcttggctcactgcaaacctccacctcttccctgctcatgcaatccttccacctcagcctccctagtagctggaactatggtgcatgccaccatgcctggctaatttttgtattttttgcagagacgggggttttaccatgatgtccaggctggtctcaaactcctgggctcaagtgatctgtccacttcagcctcccaaaagtgctgggattacagatgcaagccaccacgcccagcctatattttgaggaacttccatataattttccagaatgactgtaataatttacattcccacgaacggtgggtaagggttcccttttctccatatcttcaccaacaccagcaccaacaggtgatatctcatcgtgcttttaatttgcgttttcctggtggttagtgctgttgaacattttttcatatatttgttggtcatttctgtgtcttttttttttttaatatctgttcaggtcctttgcccattttaaatcagcttatttgtttttttcactctgagttttttgagtttcttatatattttgggtattaacaccttattggatgtattgcttacaaatgttttctcccaatctgtaagttattacttcattctgttaattttttccttatgcttggtaatccttgattgcttatcagacattgtaaattttaccttgtagaacaccaaatatttgtgtaatctttatgatttgttagacaggtccagattaatgctcagtgtaggcttaatttttttttttttttttttttttttagatagagtctcaccgttgcccaggctggagggcagttgtgccattttggtgcactgcagcctctgcctctggagttcaactgattctcctgcctcagcctcctgagtagctgggactagaggcacacgccaccatgcctggctaatttttgtatttttagtagagagtgggttacaccctgttggccaggctgctcttgaactcctggcctcaagtgatctgcccaccttggcctcccacagtgcgattacaggtgtgagccaccgtgcctgcccggcctttttaagagatgtggtcttgctgtgttgcctgggctggtctcaaagtcctgacctcaagtgatccacccatctcagcctcccacagtgctgggattacaggcatgagccactgcaccggaagtctaggtttaattattccccattactgagacaagatcttcctgagcactctaccccatgcctagcgaatgatcagtttttccagctggccagtgggaagaggtcctggccctacctcgtgtgaatcttgggcgttgtttcctcgaatcctttcagctggttctttccctggccttggagagtttcttcacacacatgtgctgattagttctttgctgaatcctctgaagtcctctggggtactctctctgtgcacctctgtcttgtaggtgttccattatctaagctctagctgctgtggtctcctcggactcagccactccatttcctcaactctgcgaatcctctgggctgcaacaacccacatcccccttgccctgccccacactttggaaacgctctcgaagcagtaaactgcacagtcctaaaaggactgttgatgtcctttctctctgggatttcattgcttttgttactttctctcattgcttgatgttcagcgttttgaacactgttgttccatgtattgggtctgtttttgtcactgtggtggtggtgattgtttcagacaggagggcggacccagcccacgtgactccatcttggctggaagcaggaatctcgggatcagtggtttcaaagctcctcaggtgattccaggggacgctgaggtgaggaccacttgcagagactcctctgcttgaaatatctctcaatcaaatggaatcttcttttgttgttcccaccccttcattttctctgttctctctttctgagttttttctttgtttttgttttttgagacaaggtcatgctgtgttgcccaggatggagtgcagtggtgccatcacggctcactgtagcctcaacctcccgggctcaaacaatcctcctgccccagcctcacgagcagctgggaccacaggcccataccatcacgtccagctatgttctctctttctggaacttctgttaaacaaatatggattgaattgattctccatctcttttctttcatattttcctttcttttctttcttttttgttggcattttgctctacatcctgagaggtgtttcaaaacttttccacccgtaccttcctttgattaattttttatttaacttaattaattaattaatttttgagacatggtctcactctgtcacccaggctggagtgcagtggtgcaatctcagctcactgcagactcaacctcctgggctcaagtgatcctcctacctcagcctcctgagtagctgggagtacagatgcactccaccatgcccggctaattattttattttttgtagagatggggttttgccatgtttcccaggctgtgatggatttttaaatttggtccgtcgtatttgtgacttccagaactttgtcttgttctccaattgcagcatcttcctggaagcctcttcttggttcgtggtgcattatcttattcattcctttcctccagggctagtgttctgctattcttcctttcttttttttttttgagacagagtcttgctctgttgcccaggctggagcacagtggcgtgatctcagctcactgcaagctccagctcctgggttcacgccattcttctgcctcagcctcccgagtagctgggactacaggtgcctgccactacgcccggctaatttttttgtattttcagtagacatggagtttcaccatgttagccaggatggtcttgatctcctgacctcatgatccacccgccttagccttccaaagtgctgggattacaggcatgagccattgcgcccaggctttttttttttttttttttttttttttgagatggagttttgctcttgttgcccaggctggagtgccacctgcagcccagtgatcttggctcactgcaacctctgcctcctaggttcacgcaattttcgtgcctcagcctcccgagtagctgggattacagtcatgtgccaccatgcccggctaattttatatttttactagagatggggtttcaccatgttggccaggctggtctcgaattccagacctcaggtgatccaccctcctcagcctcccagtaagccactgcacccaaccatctgctattcatcttaatcctctctggtggcaccgaaatgaagaggagacccatgtggatctccctgcagccgggtgagtctggttccacaggaggccttttcctgaactggctgcaggctccgcgggcaggtctgttaattggttaaaatgcttcattcagttaggtgggttttgttcccttctccccacccagaggacatttgggaatgtcgggagatatttttggttatggcagctagggggatccttctgacacctagtggatagaggccagaaatgccactaagtatcctaggacatgcaggagagcctctcaacgattaagaatcagctgtcccaacatgttaatagcacataggtcggagagacaccctgatttaaggccatctgagtacaggctccccagctctcaccaccaaaggccaagataaggagggtccctctacagccacttcagggaacttccaagggagcttgttcaattatgtttatttattttatttatttattttttttgagacggagtcttgctctgttgcccaggctggagtgcaacctccacctcccaggttcaaacgattctcctgcctcagcctcccaagtagctgggattacaggcacctgccaccacacccagataatttttgtattttttgtagagaaggggtttcatcacgttgcccaggctggtcttgaatgccatgaccgcccccagttgtgcttagaagataccgccaacaggccgggtgcggtggctcatgccttaatcccagtactttgggaggccgaggcagctggatcacgaggtcaggagttcgagcctggccaagatggtgaaaccccgtctctactaaaaataccaaaattggccaggcatggtagctcacgcctgtaatcccagcactttgggaggccaaggtgggtggatcatgaggtcaggagatcaagaccatcctagctaacacggtgaaaccccgtctcaaaaatacaaaaagttagccaagcgtggtggcacacacctgtagtcccagctactcagaaggctgaggcaggagaatcgcttgaacccaggaggtggaggttgcagtgagacaaggtcgtaccactgcactccagcctgggcggcagtgtgagactccatctcaaaataaataaataaataaataaaatattaaaacataaaaatacaaaaattagccaggcaaggtggcgagtacctgtaatcccagctactcaggaagctgaggcaggggaatcacttgaacctgggaggtggaggttgcagtgagccgagatcacgccactgcactctagcctgggtgacagagcaagactctgtctccaaaaaaaaaaaaaaaagaagacacctccagctgacagatcatgagccacatgtggcccaggcttgtcttgtttggcttttatagggagatagatttatatatatatacatatatatatatgttgttctgtagtgttgcgtcatgagatattgaaaaacacacataactttttttaaaatttgttctgggccaggcgtgtaatcccagtaatttgtgcagctgagatgggaggatcgcttgatctcaggagttcaagaccaacctgtgtgacacagtgagacactcatctctacaaaaaattaaaaattactggggcatggtttcgtgcacctgtggtcccagctgagatgggagaattgcttgagcacacgaggtcaaggctgcagtgagccaagatcgcaccgctgcactccagcctgggcgacagagcaagatcctgtctcaaaacaaacaaaaacaaaagtaaaactacaatgtgaatgcaagttttctcagaatatacatcctttaatattttgatctttgaattttcaatcactatctaccacagaatgttccctttccaaattacaactaatttataactcagtaaggaacactctgggacaagttcttttttttctttcttttttccaactctggatacagattggcagacagcagtcttgagagcttgttgggagggtctagcaggggagcacagctacttgtatgcccttgaccgaagactggtccttgtctatcggggatggttgtcctctttaacggagtgcacagcttcaggaggttgcacatggagtagtgagggaggaaggggacacccacctagccagccaggtcagctgaatcaaccctggcgatcagtggggtaacatgttgcagccagatcgccctcacatccaggcagcagtctttagtgaagtgctaacattgttcaacagagaaatccaatagctaggttggaggtgggcagagaaagggaagttataaaactcaccaggctgggcgcagtggctcatgcctgtaatcccagcactttgggaggccgaggcgggcagatcatgaggtcaggagatcgagaccatcctggctaacacggtgaaaccccatctctactaaaaatacaaaaaattagccaggcgtagtggccggcacctgtagtcccagctacttgggaggctgaggcaggagaatggcgtgaacccgggaggcagagcttgcagtgagctgagatcgcaccactgcactccagcctgggcgacagagcgagactccatctcaaaagaaaaaaaacaacaacaaaaaaactcaccaaagatttggctaacatcacatcaaaaggagtattctcattttacttaaaatgcccacatttgtgtttgttttgttttgttttgagacagagtttcactcttgttgcccaggctggagtacaatggtgcgatcttggttcactacaacctccgcctgcccggttgaagtgattctcctgcctcagcctgctgagtagctgggattacagatgtgccccaccatgcccggctaattttttgtgtttttagtagagatggggtttcaccatgttggccaggttggtcttgaactcctcacctcaggtgatctgcttgcctcagcctcccaaagtgctgggaatccaggcgtgagccaccacacccgaccccacatttgtttttatgatagaatgttttcataatttattatattactaagttgtgttttagatttttcagtttcaagtttggtttctaaaataaatgagtacaaaccacaagctcagtttctcctgaaactctcacagcctgcttctgacgtcagatgtgtgtgggttgcacactgcgttaatccattctcacactgctataaagaaatacctgagactgggtaatttataaagaaaagaggtttcattggctcacggttctgcaggttgtaaagaaagcatctgctcagcttccggggaggcctcaggaaacttacagttatgacagaaggtaaaggggaagcaggcacgtcttacgtggccagagcaggaacaagagagagagtgaaggggtaggtgtcacacacacattttttttttttttttgagatggaattttgctcttgtcacccaggctggtgtgcaatggcacaatctcggctcactgcaacctccgcctcccagattcaagcaattctcctatctcggcctcccaggtagctgggtttacaggcttgtgccaccatgcctggctaatttttttttttttttttagatggagtctcactccgtctcccaggctggagtacagtggctcgatctcggctcactgcaacctctgcctcccagattcaagtgattctcctgcctcagcctcctgagtagctgggtttacaggggcgcaccaccacacccggctaatttttttattttcagtagagacggggcttcaccatgttggtcaggctggtcttgaattcctgacctcgtgatccacccgcctcggcctcccaaagtactgggataacaggcgtgagccactgcgctcagccaattttttgtatttttagtagagctggggtttcaccatgttggtcagctggtctcaaactccagacctcaggtgattcacctgtctcggcctcccaaagtgctgggattacaggcatgagccaccgcacccggccagtttcacacacttttaaaccaccagatctcacaagaactccctctcacgacgacagaaccaagggggatggtgttaaaccatgttaaatcatgagaaaccaccctgacaatttaatcaccccccaccaggcatcagctccaacactagggtttacaatttgacatgagatttgggcagggacacagatccaaaccatatcacacaccaaacaagcaatcagttctactgcagacaccagctgggtgtcctctgatttttttttttttttttgagacggagtctcactgtcgtccagtgagattgcagtggtgcaatcttggctcactgcaacccctgcctcccgggttcaagtgattcctctgcctcagcctccggagtacctggggttacaggtgcctgccaccacgcccagctaattttttgtgtttttggtacagacggagtttcaccgtattagccaggatggtctcgatctcctgaccttgtgatctgccctcctcggccacccaaagtgctgggattacagtcttgagccaccgcgcccggccatgtccactgatttaatccaattataacatcatctacctggagatagcgtcacatctcacggggtgagggctgcatcccacaagactgcccctgacttccgatgccaattgcaagccccaggtttttttacctgcacttctaaccaactggctaataaatcagggttctcccggccctgcccttgggtgacattaacttgctagagtggctcacagaactcagagaaacatgtttaccagtttggttattataaaggatatttcaaaggccaggcacggtggcttatgcctgtaaacccagcactttgggaggtcgagacgggcagatcacttgaggtcaggagtttgagaccagcctgggcaacatggtaaaacccccatctctacaaaaaatacaaaaattagccaggcatggtggcatgcactgtaattccagctactcgggaggctcaggagtttgagaccagcctgactaacatggtgaaaccccgtccctactaaaaaatacagaaattagccgggcgtggtggcatgcgcctgtaatcccagatacttgggaggccaaggcatgagaatcgcttgaacccaggaggcagagtttgcagtgagctaagatcacaccactgcactccagcctgggtgacagagcaagactctgtctcaaaacaacaacaacaaagaaaaccaaagtgatccacccaccttggactcccaaagtgctgggattatagacatgagccaccatgccctgcctttttttttttttttcagacaggatctctcgctctgttacccaggctgtagtgaaatagtgtgataatgtgatcacagcttcctgcatccttgaccgcccccagcctcaagtgttccttccacctcagcctcctgagtggctgggactacaggtgaccgccatcatgcctggctaatttttgttttttctttttttagagatggggttttgccatgttgtccaggttggtcttgaactcctgggctcaagtgatcctcctcccttggcctctcaaagtgctgagattacaggctatgagcctctgtgcctggcccctaaactttttccaacccaccattccaccatgctccgtgtatcagctctccatactttatgacttcattgctttagtcactgttctgctacttgcagcctagggcattcctaatgacacatggtccacattagactttacagatagcctcattttctactagttttgcctatgaggaagacagccctagaaagtgacagctagattgagacctaaagagtaagaattagccaagatgaagtagtgggagggaggaagatggatgttgcaaaaggaagggagtgtttgttgaaatgatcagaagttggaaaaatcttttaagcatttttcttttctttagagatgggttctctgtcacccacattggagtgtagtggtatggtcatagctcagtgtagccttgaactcctgacctcaagggatcctcctcttcagcctcctggaattacaggcatgagccatcatgcttggctaatttatttttaaattttttgtatagacctggccacgtgtgagggctcatacctgtaatcccagcattttgggaggcctaggtgggtggatcatctgaggtcaggagttggagaccagcctggccaacatggagaaaccctgtctgtactgaaaatacaaaaatttgctgggtgtgctggtgcacacctataattccagctatttgggaggctgaggcaggagaattgcttgaactcaggatgtggaggctgcagtgagccaagattgcaccactgcactccagcctgggtgacagaccaatactctgtctcaaaaaataaaaataaaaataaattaaataaataaaaataaattctttgtagagaccgggtcttgctacattgcctaggctggtctcgaactcccagtctcaagcaatcctctcacttcagcctcccaagtagctgggattacaggagtgagccaccacatccgacccttttaagcatttttttttttttttttttggcaggcttactccaggtgcaatgtggaaaatagagacaggggaacatttaagcgcagtttaggagcaatgagtggagcagaaccaggatggaagaagtaagcatgaggagaagcaggcagaagtcaggggtgtttggaggtgctgatggggggcagaaaggagcctaggagaaagaagagtattaggcttggtgggggtggtcatgcatcctaaaataattttgaggtcttcacagggggatattgaagtggctgttagagagatagggtttgaagtcaggagagagacataggttaagacataggtttgggttcatgttacagagacccaggacgacagtgatttatacaaaagaaagtgttagttctctgtcgtgtaattacactgaggcaggcagttcaggtgtcctgtgctggctgcagggattcaagctccttccatctcctggctcagccaaccctggcatgctgccgttgtccatgatatctcaccatcatgtctggattctaaatagcaggagagagaaagaggagtggggaagaggagccagaaccagttgcatggatgcccttagccacaagggggtctgggaaatgcagcttttcctctgggtggccacaagcccagttaaaaataatggtgctggcaacgtgcatggcacacggctggaatcccagcactttgggaggctgaggcaggtggatcacttgagcccaggagctcaacaccagcctggccaacatagtgggaccccatctctacaagaaatacaaaaaatagccaggtgtcatggcacatgtctgtagtcccagctacttggaaggctgacacaggaggattacctgaaagtgaggaggtcaaggctgcagtgagctgtgattgcaccactgcactcgtcttggcaacagagcaagactctgtttcaaaaaagaaagaaaaaaagaagaggttgtattagtccattctcatgctattaataaagacatacccgagactgggtaatttataaaggaaagaggtttaattgactcacaattaagtatggctggggaggcatcaggaaacttatacagtcatggcagaaggggaagcaaaaacatccttcttcatgtggcggcagcaaggaaaagtgctgagccaaaggagcaaaagtcccttataaagccatcagatcttgtgacaactttatcaccagaacagcatggaggtaaccaccctcatgattcaattgcctcctacgacacgtggggatacagccaaaccatatcagaggtagtgctattcctttaaaataatgcgagaatagatctaggaggaccacatctgccaccgctggagatggagacatggggaacatcagggtatgagatagtaattggggccaggcgcagttggctcacgcctgtatcccagcactttgggaggctgaggcgggtggatcacttgaactcaggagttcaagaccagcctgaccaacatggtgcaaccccatctctagtaaaaaaaaatacaaaattaggctgggcgcggtggctcatgcctggaatcccagcacttagggaggatgaggtggacggatcacctgaggtccggagttgaagaccagtctggccaacatggtgaaaccccgtctgtactaaaaatataaaaattagccgggcatggtggtggatgcctgtaatctcagctacttgggaggcagaggcaggagaatcgctcaaacctgggaggcggagattgcagtgagctgagatcatgccattgcactccagcttgggcgacaaaagcgagactccgtctcaaaaaaaaaaaataaaatagctggacatggtagtgtgcgcttgtaatcccagagacttgggaggctgaggcaggagaattgcttgagcccaggaggcggaggttgcagtgaactgagatcatgccattgtactccagcttgggcaacaagagtgaaactccgtctcaaaaaaaaagagatagcaattggagccttgggcctaggtgaaatttcccagaaggagtgcagagggaggggaaaagcagcccaggactgacctttgagaaggcatgccgccagcaaagagagtcagagagcacggctgggtagcggggagggaaagcaggtgtgtgtaaagccacagagccatggggagagaacatttccagaagtgtccagtgctgtctgcaggaggcttgaaagtgtcctttgattaaaacagcaggtcatgattttgatggcagtcgtttctgtagagtgctggaagcccatggaagcctgcaaccagttgcagagggaggggaagatgagaaagtgtagactgctaggacagacggctcttcccagacgtttggctgtgaaggaggtgagaagtcgtgctgtgtgtgaggggtagagaatgagttgttggagctggacatgactcacccctgtaatccctgcactttgggaggctgaggagggaggatcacttaaggctaggagtttgagaccagcctgggcaacatggtgagaccctatgcctacaaaagtcaaaatactagttagatctggtggcatgtgcctgtaaccccaggtacttgggaggccaaggcagaaagatggcttgagcccaggagattgaggctgcagtgagccgtgactgcaccactgcactccagcctgggtgacagagtgagaccctatctcagaaaaaagaaaaaaaaaaaaaaagagttgttggttggctggttgttttaaggtgggagagatgtcaacttatttatatggggaaatagccttttgggtgatagtgtgaatggaataacctgacaagcatgtcctcaccactatgcatctagaagcgctgcataaaaccaaacaaacatcctttaaaacatgcagcttagttgcaaaaaagaaagggaaatccccaggaggcacgaagaggaaactgaacactagagctgtgcaacttgctgggtggctgtgatcttggcattgaagggcctagggctttacacctacctagagattggagataaggccttgtctggggaactgaaaacataaacactaatagaaagcttgtacccttaaggggtgacatccttggtgaaagagtaaactaggaaaaaaatctgcctccagttcagggagcataaaaggaccttgtctgtttcactctgagatttggtgacaataaatggtctcttttgagaattcataaccaaaggcttggcctcacttggacttggggttcaagtttacatcatctgcatggtctgggaagcccaaatgtcaacaaataatatagtccaggccaggtgtggtagctcgtgcctataatcccagcactttgggaggctgaggtgggaggatcacctgaggttaggatttcaagaccagcctggccaacatggtgaaactacgtatctactaaaaatacaaaaattagccgggcatgttggcaggagcctgtaatcctagatactcgggaggctgaggcaggagacctcgggaggtggaggttgcttgaccctgggaggtggaggttgcagtgagctgagatcgcaccactgcactccagcctgtgcaacagagcaagactctgtctcaaaataataataataataaataataataataataataataacaatgtagtccagggttggtaacacccatgaagagctcttggcagaagcagatgtgaaacctctttgaaccttggtgggcatgtgcattcccactgataacaccctgctgaagctgaattcacagctcaaaattacaaaacataagaggaaacaatcttcatgaatgacagtaagcagacacagcatatagcaggattagctccaactccagaactccagagaatagcattatttggcaaagaaccatacagcaagtgtggtttaaatttctaaagatataaaagaagacatcaatatgagaaagaaataagatggtgttaaaaatgagtgggattccggtcaatgaatgcgtctaaaaaaaaaagtgagcaggagaggtttaaagtaaaaagaagaaacagtaaaatgaatgtgtctgttaatctatgaacttattcattccccattcattaggctcctatagtgttttagaccatgttctgggtctggaaatataaagatgactctgcagatagcaagttagactctgcctcaggaagatcgcatgcagaaatccatgtatcaatgcatccatttatctatacatccactcatccacacatccattctcttcacctatccattctcccatccatccatccatccatccatctattcatccatccatctgtccgtctgtccatctatccatccatccatttattcatccatccatccatccattcatccatccatctagtcttccatccattcatttatttatccatccatccatccatccatccatccaaccgtctttcattttactcactgtgggggaaagaaagagagatctgactgttactgtgtctctgtagaaagaagaagacataagaaactccattttgttctgtactaagaaaaattctgccttgagatgctgttaatctgtaaccctagtcccaaccctgtgctcgcagaaacatgtgctgtgttgactcaaggtttaatggatttagggctgtgcaggatgcaccttgttaaaaatgtgtttgcaggcaatatgcctggtaaaagtcattgccattctccattatcgagtatctagggacagaatgcactgcggaaggctgcagggacctctgcccaagaaagcctgggtattgtccaaggtttctccccactgagacagcctgagatatggccttgtgggaaggggaagacctgactgtcccccagcccaacaccgtaaagggtctgtgctgaggaggattagtgaaagaggaaggcctctttgccgttgagataagaggaaggcatctgtgtcctgctcgtccctgggaacggaatgtctcggtgtaaggcccgatcatacattctatttactgagataggagaaaactaccttatggctggaggtgagacatgctggcggcaatactgctctttactgctctgagatgtttgtgtaaagtcaaacataaatctgacctacgtgcacatcgaggcacagcacgtttccttaaacttatttatgacacagagacctttgctcacgttttcctgctgaccctctccctaccattaccctatagtcctgccatatccgcctcactgagatagtagagatagtgatcaataaatactaagggaactcagagaccagtgcccgcacaggtcctccgtatgctgagcgctggtcccctaggcccactgttctctctctatactttgtctctgcatcttatttcttttctcagtctcttgccccacctgacaagaaatacccacaggtgtggaggggctggcccccttcactcattctcaaatgtcacagctagaaaagtcccaatagaacatcttgttcaactttcagctgtctttttgtacatgaaaaaagcacatgaggccccataatacaaaactctgttttctgaagtctctaagtgaataaggtgatggaggcagatcatgaactggggccttgtccctgcatttcttccacactgcagtgcctttcctgaacccatggcatggaagcatctgacctctgaacacctgcctgtatcttctgtttctctcaggtctgttcactcctcgtgggcagagtccccacaacccagtgctgtcaactgatggtgatgataaggaatgtcattacccagctcatgagtgatagagatgggacagggccctggtctctccctggtgtcagttttgtgtccatatcttagctcacccctacctttgttccctactctgccgctagagagactgtgagctccttgagggcagggcccaggtcttattcctcccctcccagtgcccagctcagaaacagtgcttaggatgctggccagtgactacacctgggagaagagactggactaggctctcggtccctctgcctggggtttctggctgctctgtcaacttccaacatcccaaaaatcagaggggaggtcaagggattggatgagaggctccaagtgctccttagcccactgtgcagggagaagtgagtgtttcctggctgtgggtgaacttcgtggacagcattaaacaacacagcatcccgccccctgtgcggggctgtctgtctgccttggcacttccagaaggtctcattgtggtgctagagtatctaacactttctgacttgcagatcaacattcccttttcttgttaacaaagagcagtgccgggcgcggtggctcacacctgtaatcccagcactttgggaggctgaagcgggcagatcatgaggtcaggagttcgagaccagcctggccagcatggtaaaaccctgtctctactaaaaatacaaaaattagccaggcatggtggcaggcgcctgtaatcccagctacttgggaagctgaggcaggagaatcgcttaaacccagaggcggaggttgcagtgagcggagatcgcgccatcacactgcagcctgggcaacagagcgagactccgtctcaaaaacaacaacaaaaacaaagagcagagttttaggtcaatgcttccagcagggaacagaatttagatcttaacaattttgtttacattgtatttattttcatgttttaccttctattgatggcaaatgagactggttttccatttacagaagtgatacaaaagattcctgttgcaataatttcattaagtgaataatgagccaatttaaagaaaaatataaagcaaataattgtacagatggtaaactaatatggcaaaatcactaatattcaaggctgaagtttggccgggcatggtggctcatggctgtaatcccaacactctgagagatggggatgagtggctctctcgagcccaggaattaaagaccagcctgggcaacatagcaagaccctgtctctaaaaaaaaaaaatagccaggtgtggtggtacatgcctgtagttccacctactagggagactgaggtgggaggatcacttaagcccaggagttcaaggccgcagtgagctgagattgtgccactgtagtccagcctgggcaacagagtgagaccctgtttcaaaaacaaaaaaaagtggccgggtgcagtgctcatacctgtaatcccagcattttgggaggctaaggctgctggatcacttgagcccaggagttggaaacctgcccaggcagtatggtgagaccgtgtctctacaaaaaaaatacaaaaattagctgggcgtggtggtatgcacctgcagtcccagctattctagaggttgaggtgggaggatcgcttgagcctaggagttcgaggctgtagtgagttgagattgtgccactgcactccagtctgggtgacagagttgagattctgtctcaaaaaaaaaaaaaaaaaaaaaaaaaagacaaagtttggaaaattaaacccccagggaaatggaaactacatctgctgctcacccacctgcctgcctctcctaaagggaagattgggtacttggggtcccatttctgtagggtggagcattataagtaagcctagcttgtggcaaatctgtctctctggacactccagcaagctggaagggacgatgatcagaggtcacagtttgggagttgccctgctctaggacaacgctcctctccacattggatgaaactcagtttcccctggccatggccttcctcaccatggagtggtgagggtccgaggctgagacgtgtgcagatggaggagaatgggcagaggagcctgtgggttttctctgactctaggtccccactccagcaagacagcgccgctgcagcttggcccagcaagttcctccttgcagtttgggggtcaaagccacagttcatatgaaacaaaatgttcctctgcctggtctggtcctctctttgtgtattttcctagaggacctcacagtgggtgagtggccaaggagaacaggatttgtggctctgggaaactggattcctgtcatctcctgccagctgtcatcgccacaccgaggctgttcagcaccgcaggacccgttctctttggtattggtggcttcggtaaacactgaaagaaggtggaggtggctggtcgatgccatttcctgactatctagtaccttgggttcttcatctggatgcgatcttgaaggcttctggcctggcattggctccacccccaggtctctgagccacagcccaggtagctgagcagaggcactgctgggcttcccctagtccacatagcctggccaccacccagacccggggagggggactccaggtggaaggagcctgggaagggcatcttcgctggggcagtctcaatcctaatgctggatcctggggtccccggtcccactgaggcaaggcctgcctcggggatctctggggaaccctggggattcagaaccccacactggtccggccttcacgcttccagaaagctgagatctgctccaaggtgacccgtggctggaggccccactcaggatccgggctccctggccgctgcctcctggcctgggggctcccaaactggacgctggcctctggcctctgctcgggttcagcccagctcaccaggcctgtggcggggggcctcccctcccagggctggggcccccagaaggtgctccgggctgggacctccagtacggtctgggggcccaagttgctgggagcagaatttggggctgagggggcaggtggggctgttgctcgggcctccaaagtgcccacctgggtgggaggctcaggggcccgatctgtcagcagggggaccgcagagccataccagtcctcagagcgctctcgggcggtgcccatgggctcaatccacagctctcctcctgggcgccacaccagggtgggtgcacggtggctggggtctgggcggagagcacggcggaacaggcgttcagccaacacagcggtggtgaggatgaagagcgcagccagggtggccaggaccagcatgatggggatgcagggcccacagggcagtgagggccatggggctgcttcccatgcggggggcccctccacgcgcccagagggcggctctggagtcaacggcatctgagagacacaggggtgagaagaggaagtaaatgaggcagagggggcacaaccaagatgagagagaggcagcaggtgtccaggaaagcctgggagaagggctgggcatgggggctcatgcctggaatcccagcactttgagaggtcgaggcgggaggatcacttgagcccaggagttcaagaccagcctggacacacagtgaaacctcatctctaaaaataatttaaaaactagctgggtgtggtggctcacacctgtagtcccagctacacaggaagctgaggtgggaggattacttgagcccaggagtttgaagctgcagtgaccccagattgcaccactgtcctccagcctgggcaatagagcaagaccctttctcaaaaatgaaaaagaacattctggagagacagagaagcaagagggaccagaaagggtaagcgtgagccaggtggggtgggaggacaggcagcctacctcggggcacagccaggccctcctgcctggctctccaggcctttccagaatccccatttccctcccagaccccagggtgcctcagacaagaaaggtctcaagggcttctttcctccccactcggccccctcaagtcttgctcagacctagagaggaagtggtgggtgaagaaatgagaacctcccctcccactggctcccctgcgtgtgtctcccccaccgcctgccgccagcacctccgctggccccttgaggctccttcgcccctcaccattctcctcggacttgatcttgctctcataggctccacggaatctgctgccgggccgggccgggccaggcctccggaggcgcctctgcacccctcctgggctccccagctttgcccaggctctggcctgtctctatctctcgtttgtctctgcacacctctctgtcccccacatcctccatctgcagggggcctcctgcacccctcaactcaccttgggtcagtccctgggctcctctccctcctagagccactcttcctggtgctggactaagaggtgcaggcttggagggtgcagggcggtccgcctctcagacgtagaggcccggcctcggatgaaggcggaagggagggcaccgcctgttgctgggcaactgtgccccaactcgtctgcccctggggagtgtttgtttccaaagcaacccaaggggatgtggtcactgcggtgaggaggcttttcctggggtaaggtggggctggaatgggcaatggttctgttgaacttagtgtcaccccatagccaggccctgagccccagaacattcaccgaaaagctgagaaagaggacgccggggccaggcacagtggctcacccctgtaatcccagcattttgggaggtcaaggtgggcaagtcacctgaggtcaggagttcgagaccagcctgccaacatggcgaaaccccatctctactgaaaaatacaaaaattagctgggcatggtgacgggcacttgtaatctcagctgctcaggcggctgaggcagggagaatcgcttgaacccgggactcggaggttgcagtgagctgagatcgtgccaccacactccagcctgggcaacagagtgagactccgtcttaaaaaaaaagaaaagaaaagaaaagaaaaagaaataggacactgggactttagcccgtacattcccagagaaccatggtgcctcccccgttcctcctgggaggatgccccaccccatcctgccttgtcttatccacggtgcctccccagatctgctcctgccatgcagcccccacaggcaccccctgcttggccagcttgcttcacaccttttttttttttttctggtagagatgggctcttgctatgttgcccaggctggtctcaagctcctggcctcaagagatcctcctgcctcagcctcccaaagtgctgggattacaggtgtgagctaccacactggcccctgcctcatacttttaattaacataagtctctctctcttcagaccatttagcccccattttggttggaaaatatcagtgaggtgaggcttgggtaacaaaaatgtcaagcctctgagaggagtccagggtataaaaacaggcgtgggcctgtttccaaaaccctgaccatcctcatgtctgtccctctttcctgctgctgagggtgggaggagcctggagcagagtgtgacaagatgtcatcaggctctggagtccaggtgactttctgagattctctagtttgactcatccacagatgacaaaagtaaggcttaaagaaaagagatttcatgaccaaagtcgcatgaccaatgtatgtgtgggtgagcatgtagtggccagggtggtggaagaatagatagaaatccctgggctgggcgaggtggctcatgcctgtaatcccagcactttgggagaccgaggcgggtggatcacctgaggtcaggagtttgggagcagcctggccaacatggcaaaaccccgtctctactaaaaatacaaaaattagccgggcgtggtgccgcacgcctatgaccccaactactcaggaggctgaggcaggagaatcgcttgaacccggtgcagtgagccgagatcgtgccattccactccagcctgggcaacagagcgagactctgtctcaaaataaataaattaaataaataaatgaatgaaaagacagtctccgtcagactgccccatcctggtggttttgagccctgctgggaggagctggagatggagagtccgggggaaaccgcctttgcaaagaaagagatctaacttaactgactccaccttgcttctaacctccaagctgtctttgtttattcctgggcgtaggctgaactaactttgggagaaacttagtttgtagtttatagtttaaacaaagacagtaacagccctttcccaaagcagaccttcttgcctggggactagactaacactagccataggattagaaattatggtttaggagtcatgcagctggaggctacaagattctgaccctccctaaactgctcctaacatcagtgcttgagatattttgcagaccctgcacttgatggatcagctggcaccacccagatcaataaactggctcatctgatcttgtggcccccacccagaactgactctgcaagaagacagctctgactcctgatgatttcatctctgaccaatctgcactcccagatcccagcactttgggaggaccagacaggcagatcacaaggtcaggatgagaggtgacagcgtgctggcagccctcactcactctgggcgcctcctcggcctccacgccaactctccctgcgcttgaggagcccttcagcccgccgctgcactgtgggagcccctctctgggctggccgaggcgggagcccgctccctctgcttgccagaggtgtggagggagaggcgcggacgggaactggggctgcgggccacgctcgagggccagcatgagttccgggtgggcgtgggctcggtgggccccgcactcagagaggccggctggcgccattggccccaggcagtgaggggcttagcacccagaccagcagctgcagagggtgcgccaggtcccccagcagtgccagcccacaggtgcacttgaattctcgcaggcctcagctgcctccccacggggcagggcttgggacctgcagcccgccatgcccaagcgtccccctgcctgggctcctgcaccgccccctgctctgcggggcctggtcccatcaaccgcccaagggctgaggagtgcaggcacaggattggtgggcagctccacctgcagcccaggtgctaggtccactaggtgaagccagctgggctcttgagtctagtgggcacttggagaacctttatgtctagctaagggattgtaaatacaccaatcagcactctgtgtctagctcaaggtttgtaaacacaccaatcagcaccctgtcaaaatggaccaatcagctctctataaaacagaccagttggctctctgtaaaatgggccaatcagcaggatgtgggtggggccagataaggcaataaaagcaggctgccagagccagcagtggcaactcggcgtacccttccacataggaagctttgttcttttgatctttccaataaatcttgctgctgcttatcctgggtctgcactgcctttatgagctgtaacatcgtgaaggtctgcagcttcacgccagaggccagcgagaccacgaacccaccagaaggaagaaactcggaacacgtccgaacatcagaaggaacaaactccggacatgccgcctttaagaactgaaacactcaccgtgagggtccgcagcttcattcttgaagtcagtgagaccaagaacccgccaattctggacacaaggagatcgagaccatcctggctaacacggtgaaaccccatctctactaaaaatacaaaaaatttattaggcgtgttggcggatgcctgtagtcccagctagtcccagctactcccagctacttgggaggctgaggcgggagaatggcatgaacctgggaggcggagcttgcagtgagccgagattgcgccactgccctcaagcctgggcgacagagcaagactccatctcaaaaaaacaaaacaaaaacaaacaaaaaaaccctctgtttcccgaatgctcagggagactgatttgagtaataataaaactcctggctggacacagtggctcacgcctgtaatttcagcaatttgggaggccaaggccggtggatcaccttaggttgggagtttgagaccagcgtgaccaacatggagaaaacactgtctctactaaaaatacaaaattagccaggtgtggtggcaagtgcctgtaatcccagctactcaggaggctgaggcaggagaatcacttaaaccctggaggcggaggttgcagtgagccgaggtggcaccattgtactccagcctgggcaaaaagagcaaaaccgtcaaaaaaaaaaaaaaaaaaaaaaaaaaaactccggtctcctgcacagctggctctgtgtgaattactctttattgcaattttgctgtcttgatgaatcggctatgtgtaggcagcgggcaaggtgaacccctttggcagttacagggggaagctaaggctcaggacactcgcagaaacctgaggaggctagaattttaccagattacaagccttaaaatcaaacctgaagttagtgccagcgaacaacacgcttaaaaataactaagatgttctttctggctgttctagaggtcaatatagaaaaatgatagtaactttgatgttattttatgttatgtatttctttttttcttttgagacggagtctgtctctgttgcccaggctggagtgcggtgacgcaatcttggctcactgcaacctccgcctcccgggttcaagatattcttctgcttcagccatccaagtagctgggattacaggtgtgtaccaccgtgcctggcagttatgtgtgtttccctacaatcaaacaatgatttattgtaaaaaaaaaaaaaatcaaaataaacaaaacctgaaaacttgtatgtgctcttttaatcaatctttttaaacaaacttttagaagagttaacattattaaaaactggaaagatcagacatggttttttcttactaagatatcactggctgttttgattctttcatcacgtacaagtttaggccctacacaatggttcatgcctgtaatcccagcactttgggaggccaagacaggtggatcacctaaggtcgggagtttgaggccagcctgaccaacatggcgaaaccccgtctctactaaacataccaaaaaaggccgggtgaggtgactcacacctgtaattccagcactttgggaggccaaagcaggcggatcatgaggtcaggagttcgacaccaacttggccaacatggtgaaaccctgtctctactagaaatacaaaaattagccgggtttggtggcaggtgcctgtagtcccagctacttgagaggctgaggcaggagaatcgcttgaacccaggaggtggaggttgtagtgggccgggatcatgccactgcactccagcctgggtgacagggcaagactctgtctggggaaaaaaaaaaaaattagctgggcgtggtgacacatgcctgtaatcccagctactcaggaggctgaggcaggagaattgcttgaacccaggaggaagaggttgcagtaagctgtgatcatgccactgcactccaccctggacaacagagcgagactctgtctcaaaaaaaaaaaaaaaaagtttaaggccaggcaaggtggctcatgtttgtaatcccacaattttgggagactgaagcaggaggattgcttgagggcaagagtttgagaccagcctgggtaacatagcaagactcccatttctacaaaaaatcaaaaaattagccaggcatgatggcatgtgcttgtagtcttagttacttgggaggctgagaggggaggatcacttgagctcaggagttcaaggctgcagtgagctatgggtgtaccactacactccagcctgggaaacaaagcaagacactgtctcaacaacaaaaaaagaccaagtatatttagtcattctataaaatttaagaagccagccaaaaacatttatgttcagcaatttgtttcagttatttcttcttacttggaaataatacacacatctaatgaataatagttaatttaatagaacataatagaagatttaaaattacatgaaaaatttatttataataaattatccattacatactttatttttaacagtttccctagattatttatgaaaactgagatattaggcaaggatagtcattatttcaagttacttccctgttaatcatttttatagcctgtgacaatcaggtattcacctaagtaagaagcttaaacatatgagtaatttcttgataactcaggagatacagttttttttttttttttttttgaggtggaatctcgctctgtctcctaggctggagtgcagtagtgtagtctcggctcactgcaacctctgcctccaggttcaagcgattctcctgcctcagccccccgagtagctgggactacaggctcctgccaccacacctggctaatttttgtatttttagtagagacggggtttcactatgttgtccaggctagtcttgaactcctgacctcaggtgatccacccacgtcggcctcccaaagtgctgcgattactaaaccaccatgcccggccgatatagatgtttttactaaatgaaaaatattaaattagtattacttatcaaaaattacacaggctgggcgtggtggctcagatctgtaatcgcaataatcacactttttctttttcttttttcttttttttttgagacggagtcttgccctgttgcccaggctggagggcaatggcacaatctcggctcactgcaacctccgcctcccaggttcaagtaattctcctgcatcagcctcccgagtggctgggattacaggcatgcaccaccacgcccggctattttttttttttttttttttatctttagacagagtttcaccatgttggctgggctggtctcaaactcctgacctcatgatccatccgcctcagcctctcaaagtgctgatattacaggcgtgagctactgtgcctagcaacactttttctttttctttttttttttttttttttttttttgagacggagtctcactctgtcacccaggctggagtgcagtggcatgatctcagctcactgcaacctccgcctcccaggttcaagcaattctcctgcctcagcctcccgagtagctaggattacaggtgtgtgccaccatgcctggctaatttttgtatttttagtagagatggggtttcactatgttggtctcaaactcctgacctggtgatccacccccttcagcctcccaaagtgctgggattacaggcatgagccaccatgccctgcgtcactttttcttttaattaatttaaaaaaatttgtttttagacagagtctcactctgttgcccaggctggagggcagtggcttgatctcagctcactgcaacctccacctcctgggttcaaatgattctcctgcctcagcctcctgagtagctgggattacaggtgcgcaccaccatgcctggctatttttttttttttttgagacggagtcttgctctgttgcccaggctggagtgcaatggcatgatctcggttcactacaacctctgccttccaggttcaggcgattctcctgcttcagcctcccaagtagctgggattacaggtgcccgtcaccatgcccagctaatttttgtatttttggtagagatggggttttgccatgttggtcaggctgctctccaactcctgacctcaggtgatctgcccgcctcggcctcccaaagtgctgggattacaggtgtgagccactgcgcccggccattttaatttaaatagagatggggtcttgctgtgttccccaggctggtctcaaactcctggcctggagcagacctcccacctcggtgtcctgaagttctgggattataggcataagccaccatacctagcctaatctaaacactttgggaggcaggaggattgcttgaagatagtagttcaagaccagcctgggcaacacagtgagactccatctctaccaaaaaaaaaaaaaaattagctgggcatggttccatgtgcctgtagtcctagctactcaagaggctgaggcagaggatcacttgagcccaggagttcgaggttacagtgagttatatcatgctacctggacagcagagcaagaccctgtctctaacaacaacaaaaaattatacaaacacagatcattttgtttaaaactggatttgtagtcttataacccttgtgtcagaccctgacaccttaaaacatctagtagagataaatataaaactgtctggccagtaaacccaagcaaaaatgtatgctgataattctgaagacatttctatttttattttaccaatactttttttctttgtcttttttttttttttttttttttttttaaagagagttttccttggtcacgccagctggagtgcagtggcatgatctcagctcactgcaacctctgcgtcctgggttcaaacaattctcctgcctcagcctcccaagtagctgggattacaggcacttgcctccacacccagctaccttttttgtatttttagtagagacaaggtttcctcatgttggccaggctgatctcaaactcctgacctcaggtgatccacccacctcacccttccaaagtgctgggattacaggtgtgagccaccaagcctagcctattttaccaatagttttaaaaccagcttatttattaaagattaaagatttacggcagggcacggtggctcatgcctgtaatcccagcactttgggaggccaaggtgggcggatcacgaggtcaggagatcgagatcatcctggctcatagtgaaactccatctctactaaaaaaaatacaaaaaagtagccaagtgtggtggcccacgtgtgcctgtaatcccagctactcgggaggctgaggcagaattgcttgagcctgggagacggaggttgctgtgagctgagatcatgccactgcacttcagcctggccgacagagcgagactctacctcaaaaaaaaaaaaaagaaagaaaaaaaatttttttttcagtttcggctgattgaggtggctggtgcctgtaaccccagcactttgggaggccggtgtgggaggattgcttaaacccatgagctcaagaccagactgggcaacaaagtgagacctcatctgtacaaaaaatgagaaaattacctgggcatagtggtgcatgcctgtagtcccagctcaggattcaactggggaggtcgaggcaggaaaactgcttgagctcaggaggttgagctgtgtttgtgccagtgcactccagcctgggcatgagagtgagactgtctcaaaaaactgttttttatcagtttcaaatgagtttagggttaaattttcaattgtttacattttagccaggattggctaaattgtataagaaatacaaaatatctaagtgccctggaactagtaacacgtctatgttttgtttgctgatctggtttgatttgcaaatgtgggcaggaaagaactttagcaggtgttttttttattttgtttttgtttttgccttttggcctctgtgtgacagaaaaagcaacatttttatgctggacagagataccttacattattgctctgagctcaaggtttcaacttctttgatctaagagagtctaacttttatagaccttttttttggtgttttattttattttattttatttgagacggagtcttgctctgttgcacagggtggagtgcagtggcgtgatcttggctcgctgcaagctccacttcccaggttcaagagattctcctgcttcagcctcctgagtaattgggacaacaggcacgtgccactgcgcctggctaattttttatatttttagtagagacggggtttcaccatattggccaggctggtctcgaactgtttttttttttttttttttttttttttttttttttttgagacggagtttcgctctgtcgcccaggctggagtgcagtggtgcgatctcgactcactgcaagctccgcctcccgggttcacgccattctcctgcctcagcctcccgcgtagctgggactacaggcgcgcaccaccatgcccggctaatttttgtatttttagtagagacggggtttcaccgtgttagccaggatggtctcgatctcctgacctcgtgatccacccatctcggcctcccaaagtgctgggattacaggtgtgagccaccgtgcccggccccggtctcgaactcttgacctcgtgatccgcccgcctcagcctcccaaagtgctgggattacaggcgtgaggcaccgcgcctggccttataaacatttgtctagttatttttctttcttcctttctcgctttctttcttcttttttttttttttttttttttttttttttttgagatggagtcttgctctgtcacccaggccagggtgcgttggcgtgatcttggctcactgcaacctccacctcctgggttcaagcaattctctcatctctgcctcctgagtagctgggactatagacatgcaccaccacacctggctaatttttgtatttttagtagtgacggggtttcgccatgttgggcaggctggtctccaactcctgacctcaagtgatccgcctgccttggcctcacaaagtgctggcattacaggcgtgagccaccacacctagcctttttctttagattattactttttcaattaagtgtttcatcactctaagcaattgttaggcaaacctaattttatgtttttaaaacatggctagctgtcacgcccgtaatcccagcactttgggaggtcaaggtgggcagatcatgaggtcaggagatcgagaccatcctggccaacatggtgaaaccccatctctactaaaactacaaaaattatctgggtgtggtggcaggtgcctgtaatcccagctactcgagaagctgagatatgagaatcgcttgaaccagggaggcggaggttgcagtgagccgagatcacaccactgcactacagcctggtggcagagcgagactctctttcaaaaaaaaaaaaaaaaagaaaaaaaaaagaaaaggactaactggtctgaatattgtgcacctgttagtactagctactccagagtctgaggcagcaggattgctgtagcccaggagtttgaggtcacagtgagctacaatcatgccactgtactccagcctgtgcaacatagcaagatactgtctttaaaaaaaaagttgtctaggttgttggttaccatggagttgtaatttgaaagccctttaagacttttgtttaatcttgacttgaatgccataagcagtaagtgttatctcaacaccaggggaaaagttagcagattcaaagcaggcagaaaaaaaaaaaggagagaaagagaacttagaagtctctccatgctaactctatagttgtaggttttatgaataatgaccatttgagctctgaattttccttgatgtaattttgctcatcagttttaaaatgtgcacaagaatgagccataatatgtagctggtggagtcctagaaatccttgcattggccaggtgtggtggcttaagcctgtaatcccagcactttgggaatccgaggcgggtggatcacctgaggtcaggagttcgagagtagcctggacaacgtggcgaagccctgtctttactaaaaatacaaaattagccgggtgtggtggtgcatgcctgttatcccagctactctgaaggctgaggcaggagaatcacttgaacctgggaggcggaggttgcggtgagccaaggtggcactattacactccagcctgggcaacaagagtgaaactctgtctcaaaaaaaaaaccaaaacaacaacaacaacaacaaaaaccagaaatcctggtacgccttcatgtttgagaatcccattccatttctttatcttgttttttttttttgagacagtgtcttgctctgtcgcccaggctggagtgcagtggtgcgatctcggcccactgcaacctctgcctccaggattcaagtgattcttctacctcagcatcacgagtagttgggattacaggtgcctgccaccatgcccagctaaattattttttttgttttggtattttttagtagagatggggtttcaccatgttggccaggctggtctcgagctcctggcctcatatgatccacctgcctcggcctcccaaagggctgggatcacaagtgtgagccaccacaccatccccattccatttcttattcatcacttgagagcaaagaccaccctatacatgctgtaatttatgggatattaggagtttagtctggtgttttagacagcaggaaccaccctagtggcttatgttagccatcctccacccactggttggaatgtttatttttgctcttgggagatttttagaaataagcaagagaaaagagtcaaaccaaatccaaagaaaccaagataagagtgttcacaaaaattttaatccaaactggccatgcagaccaaaggttgcagtgagccgagattgcatcattgcactccagcctgggcaaaaacagtaaaactccgttaaaaaaaaaaaaaaagagggaggctcagcctgagagaagactcagcagggcagaacaggcctgttgtggaagcagagagctcacagccttcagtgagtgctgcatgccagttctaagaatcatcgattcttgggaggctgaggcaggcagatcacctgaggttaggagtttgagaccagcctggccaatgtggtgaaaccctgtctctactaaaaacgcaaaaattagctggacatggtggcgggcgcctgtaatgccagctactcaggaggctgaggtaggagaattgcttgatcctgggagacggaggtggcagagagctgagatcgtaccactgcactccagcctgggtgacagagcgagactccatctcaaaaaaaaaaaaaaaaatcatcaattccttctaatagtgattttttcaggtaccatttctatatatagatataccatgtatatctacctaataacagagggtctttaaaagaaaatgatgtttatttgggaatagtgcaatgggaatacatatgctatagcaaacaatgtgtgtattcagggaggtaaaggaacaaagatcaacaacaatgccaggcacagtggctcacgcctgtaatcccagcactttgggcggctgtggtgggaggatcacttgaggccaggagtttgagaccagcctgggcaacatagtgagaccccatctttaaaaaaaaaaattttttttttaaattacctgagtgtggtggtgtgcacctatggtcccagctactcaggaggctgaactaggaggatcccttcagcccaggagtttgaggctacagtgagctataatcatgccattgtactccagcctgggtgacaacatgagaccccaaaaggagaaagagagtgagagaggaaggaaggaaggaaggaaggaaggaaggaaggaaggaaggaaggaaggaaggaagaaaagaaagaaagaaagaaagaaagaaagaaagaaaggcagagaaagaatattagctgggcatggtggcatgtacctgtagtcccacctactcaggaggctgaaatgggaggattgcttgagcccaggagttgaagaccagcctggacaacatagcaagaccctatctctacaatatatacatatttttttttttcctgagatggagtcttgcttgcccaggctggagtgcagtggcatgatctcggctcactgcaacctctgcctcccgggtttaagcaattctcctgcctcagtctcctgagtagctgggattacaggtgtgagccaccacgcccagctaatttttgtatttttagtagagaccgggtttcaccatgttggccaggctggtctcgaactcctgacctcatgatccccctgccttggcctcccaaaatgctgggattacaggcgtgagccacctcacctggcctttttttttgagatggagtctccctctgtccccaggctggagtacagtggtgcgatctcagctcactgcaacctctgcctcctgggttcaagtgattctcctgcctcagcctcccaaatagctgggattataggcccccccacgacgcccagctaatttttgtatttttagtagagacggggtttcaccatgttgtccaggatggtcctgatgtcttgacctcatgatccacctgccttggcctcccaaagtgtgagattacaagagtgagccactgcgcccagccaaaatattgttttaaattagccagatgtggtggcacacacctatattcccagctactttggaggctgaggtgggaggatcacttgagcctaggagtttgaggctgcagggagctatgatcgcaccagcgtactccagcctgggcaacagagaaagaccctgtctcaaaaaaaaaaccaaaatagttatgctccttggagttgtgtccttggcactcttggttcctgagtctatatggcgggtttttgtttgtttgtttgtttttgagatggagtctcactctgttgctgaggctggagtgcagtggctccgtgtcggctcactgaaacctccgtctcccgggttcaagcaattctcctgcctcagcctcccgagtagctgggattacaggcgcctaccaccacacccgattagtttttatatttttagtagagatggggtttcaccatgttagccaggctggtcttgaactcctgacctcaggtgatccacccaactcagccccccaaagtgctgggattacaggcgtgagccaccgcgcctggcctacgtggtggttttaaaacatgtttgcaaaatttttaacattcctcctattgaaaatagtaagtctaattcccctcctcttgaatattggctggccttagtgactgaatcctcacaagtagaatgcatcaggagtgtcacactatgacttccaaggctaggttgaaaatataaaaggggtaaagctctctttcctctgtcgctctatttctttctctttctctctatccccacccttttccctctcctccctctactcacctttggaacccagccgctatcgagcccaacacacacgcaggtgccctggttaaagtcctagctagggtcccaagtgacagccagcatcaactataacatgtaaaggagccagtcttcagatgattccagcctcagccttcaggccactcagctggtgccaaatagagtagggatgagctgtccccacagagacctgcccagtgcacattgtgagaaaggtaagtattgctctctgaggccattaagtttgggggtggtttatggcataaaaattggtaattggagcactcgacttcaagggttctcaccaggtgtgtgagggtgagggtggccctgcggagtgagtggcctgtgggggctggtcatatttcatccctaggctctcccgacctggctctgccagattcttacacggatgagggcctggactggggaggaggagggggagtgcagcagcagcaagggcatggaattggctgagaaattccacaggaggccaggtgcagtggcttacacctgtaattctagcactttgggaggccgaggcaggtggatctgaggtcaggagtttgagaccagcctggccaacatggccaaaccccgtttctactaaaaatacaaaaataattaggcatggtggtgggtgcctataatcccagctactcgggaggctgaggcaggagaactgcttgaacccggggggcggagattgcagtaaaccaagattgcaccactgaactccagcctgggtgaaagagaaactctgtctcataaaaaaaaaaaaaaaaaaagaggccgggcgtggtggctcatgtctgtaatcccagcactttgggaggccaagtcgggtagatcacttgaggtcaggagttcaagaccaggctggccaacatggtgaaacccccgtctctaataaaaatacaaaaattacccggatgtggtggtgctggcctgtaatcccagctgctctgtagactgaggcaggagaagcgcttgaacccgggaggcggaggttgcagtgagccgagatagcgccaccgcactccaggccagcggacagagccagactctgtctcaaaaattaaaaaaaaaaaaacaaaaagaaactaggaaactggcaggagctgtctccaggtcccaaaaggataaagtgaaaaacccggcaggccagcagatggccaaaaaagccatccctagctgccctcattgctcattagggtaagacactctcatcagcgccatgacagtttacaaatgccatggcaatgacccagagactattgccgtttccatacaatgacccagaaattaccacccctttcctagaaagttctgaataacttgcctcttgatttgcattaacccaccccttaatttgcatgtgattgagagtggatataaatacagttgccaccaacccacaagcctggttctggcaccctgcctatgagttagccttgctcagcaaggagcagctccagttcgataaaagattgctgaagattggccaggcgcagtgtctcacgcctgtaatcccagcactttgggaggccgaggcgggcgaatcacaaggtcaggggatcaagaccatcctggctaacatggtgaaactccatctctactaaaaatacaaaaaaaattagccaggcagggtggccggcgcctgtagtcccagctactcgggaggctgaggcaggagaatggcgtgaacccgggaggcagagcttgcagtgagccgagattgcaccactgcactccagcctgggtgacagagcgagactccatctcaaaaaaaaaaaaaaaaaaaacagattgctgaagatttcacccctgaattcttttctgggcaaagccaaggaccctcttgggctaagccccggttttagggcttgcttgcctgcccctgtatttattccagaaagttctgttggacattgttgatgggtaggaccttgggcactatccagagtgtggtcttagaatcagcatcatcaaggccaggcgcactggctcgcctgtaatcacaacactttgggaggccgggtggattacctgaggtcagaagttcgagaccagcctggccaatatgataaaaccccgtctttattaaaaatacaaaaaaattagccggacgtggtagcgggcacctgtaatcccagccatttgggaggctaaggcaggagaatcgcttgaacgtgggaaacagaggttgcagtgagctgagatggcaccattgcattctggcctgggcggcaagagcgaaactctgtgtcacacacacgtacacgaaaaaaggaatcagcagcatcaggatctcctaccccctgcccctggcaattacccatctgctttctgtccctgtggctgtatctattctagacgtttcacatgagtggaatcctgccctgtcatcctttgtgcctggctgggttccggtggcctgatgcttcatggttcacccatgcgactgcacggctccttgtccatggcatggatagactgcattttgtttattcattagttgatggatatgtgggttgtttccactttttcgctgttacaagtaatcctgctatgaaaattgatgtcccagtttttgtgtggacatatattttcagtttatcttgggtatatacccaggagtagaatgctgggtcatatggtaaatctatgtttaactttttgaggaactgtgggtggcccaatttacaactgctaagttcatccacttcttactttctccacggaactcacacttacagcagtgatagctttcacacctccctcgtccgcactgttaaacactaccacaaatcaggctactgggaaaagcctggaggccaccagcctcctgcaagaaaagcaccagcaggctgggcacagtggctcactcagtggctcatcccagcactttgggaggcggaggcacgcggatcacctgaggtcaggggtttgacatcagcctggccaacatggcaaaaccctgtctctactaaaaatacaaaaattagccgggcgggtggtgggcacctgtaatcccagctactcaggaggctgaggcaggagaatcgcttgaacctgggagatggaggttgcagtgagccaagatcacgtcactgcactccagcctgggtgacagagcaagactccctctctctaaaaaaaaaaggaaaaaggaaaagcaccaacacaggtgacgcaggtcctctaggagaccgtgtctggttctcttcctgccacacgcatgccactcatgccgctgaagccaaaacacctcctcctatgtgaccagaattctgggtcattttatgatttctttctttttttaaattaaaataaaaaaatttttttagacacacgatctccctatgttgcccaggctggtctcaaactcctgggctcaagcaatcatcctgcctcagcctcccaaagtgctgggattacaggcttaagccaccaaactagacctttttttgtttttattttttagggacaaggtcttgccctgctacccaaaccagagtgcagtggtacgatctcggctcactgcagccaaaacctcctaggcttaagtgatccttccacctcagcctcccaaagtgctgggattacaggcgtgagccaccacagtagacctcctttttgttttattttttagggacaaggtcttgctctgtcacccaggccagagtgcagtggcatgatctcaactcactgcagcctcaacctcctaggctcaagtgatcctcccacctcagcctcccaaagtgctgggattacagatgtgagccaccatgcttggccccatgagacatttaaatcttcaagaagagggtccagggcttcctgttgttcttcccatcaccctcgcccctctgcagggggtcctaacgcagctaacagttccagccttcttcaggggcttcttgctgtcagcacggaataaagtcagagctgagctcaggagagttccgtcactcgccaagactggccaggtctcttctgtccttggctgtcaagattccaaacttgagaagtgagaaaaacaatgggaatgagttagaaagttcccaagtgccacctttctgaaggaattccagggtggaacaagctgggttttgcagccagttagccctaagattaaatctgagcttctctgtttaatagctgtgagagtcttagcaactacttaatttgggtgggtctgaatttctatttttcactaattcccagcgtgaatggctgtcaggggggtaatagtttatttatttatttttatttaatttaattaattaatttatttttgagacagtctccctttgttgcccaggctggagtgcagtagtgcaatctcagctcactacaacctccgcctccttggttcaagcgattctcctacctcagcctcccaagtagctggaataacaggtgtgtgctaccacgcccggctaacttttgtatttttagtagagatggggtttcaccatgttggccaggctggtctcaaactcctgacctcaagtgatccgcctgccttggcctcctaaagtgctgggattacaggcgtgagtcattgcacccggcctggataatactagtttagataaaccacttcataaagtgggtatgcaatgctttgtttcctctcaccttgacccagcattgcttgtcatctctgaaagaccacaaagagacctgcccctccacttcagggacccacttgaaacctggtcaccatccaggcttgctctgccttggccatcaggttccctgggcaccaagcctctcttttctcccgctgcacctgccagcccgtctgacagcactggatcctgcaccctggagtccgtttggactcacctgccctgaccttacttggcttcctctgtgatgttgactttatcgaccgcttttgccagcctggtctgtcggccacaccctacccataaatcttctaccttggatctatacaactgcctcccttttgtcctgtccccagggtagtgagccctccagggcctgcagccccagctgtcctgatccttttctcctgaagcaaaggaagatgtgttcatagtgtacccactgctgatctttctcctctgtccaaacatctccagtcctgtgctactgccctggacataatcgtttattttgtttttttgttcttttttttttttttgacacagagtctcactcggtagctcaggctagagtgcagtggcatgatcttggctcactgcaacctccacttcccggattcatgtgattctcttgcctcagcctcccgagtagctggaattacaggcacgcaccacctcacctggctaatttttgtatttttagtacagacggagtttcaccatgttggccaggctggtctcaaactcctgacctttggtgatccacccaccttggcctcccaaagtgctgggattacaggcatgagccaccgtgcccggcctgccccggccatattagattctgagtcttctatgtccctgacaattggctaagcacattttaatatgtcttgtatttttttttttttttgagcagagtcttgctctattgtccaggctggagtgagtggtacagtagcggctcatagcaacctctgcctcccgggttcaagcgattctccctgcctcagcctcccgagtagctgggattacaggctcccgccaccatgcccgactaatttttgtatttttagtagatgcagggtttcactatgttggtcaggctagtcttgaactcctgacctcaggtgattcgcccgcctcggcctcccaaagtgctgggattacaagtgtgagccaccacgcctggccctaacctgatgtttttatcagcatctgtaagataagacttcaggaactggtagattctgcaggagtaacatggggtgcccatagagaaggggccctcttatgaccacagcatttaccataacctgtgtaatgggcatattcagtgggtgaatattcctgtcaccacaaacccagttgcacatgacttgtatacaaagcatatcagctgcttcaccaggggtgctccaattggcgtttataggggaagttgggcagttcccttctgagggtaaacatatgtttgttttttttgtttgtttttttttttttggagacagggtctcacattgtcacccaagctggagtacagtggtgcgatcacagctcactgcagcctcaacttcccaggctcaagcgatcttcccacctcagcctcctaagtagctgggactacaggggctcaccaccatgctcagctaatttttttatttcttgttgagatgggatttcatcatgttgcccaggctggtcttgaactcctaagctcaagtgatccacccacctcagcctcctaaaatgctaggattacaagcgtgagccactgtacctggccaacacacttagcagtggcttttatccactccaccaggctatgagcatgctggcccttcatgaatattcataggtcctcttataacctgttgaatacgtacaccttgtcaacccattcagcataaattcctgtctcatctttctctccctcaaaatgatctatgccagaggctacacttcccagcttgtcaagatggccaccctaccaccgcaacccctgataggaaataatgtctcctctccaaatttgtagatatctgtgtttgtttgtttgtttgtttttcctgagatggagtctcaactctgtcccccagactagagtgcagtggcaaaatcttggctcactgcaacctccgcctcccaggtgcaagccattctcctgcctcagcctcccgagtagctgggactacaggcatgcgccaccatgcgcagctaatttttgtatttttggtagagacagggtttcaccatgttggcaggctggtctcaaattcctgacctcaagtgatctgcctgccttggcctcctgaagtgctgggattacaggcatgagccaccatgcctggccagatctccagattttaagttgatgccttagaatatcacattgtcgtatgttctagacagtgatcactcttctgaggaggaaaactaataaagggaacaaagggcaaataaattaaacaaaggtcaaaaccaaagcattgcagttgcaaagcaattcagtaggagatgtggaaattgtgaagcagaaactccaaagttaaacaaagttaccatgtaaattacaccacaataaaaacaaacgaacaaacaaaaaacagaaagttaaaaccaggagcttcagttgtccaaatcaatggacataaaattcttcttccagtcttatgatgcatttgacaagatctccagtatctactcaagttaacccatgaaatatagctaatggtagatgagtaagataaaggctgtccagatctttatctgaaagaggccgaaaagaaagaccagagtatttcgtgaaaatctgaagggagaataaaaatttcacttactacctaccacgtgccaggcctgtaccagggggttgaaaaaaattggtgggtcttattatctccaatttacagatgaaaaaactgaagctccaggccgggcacagtggctcatgcccttaatcccagcactttgggaggccgaggcaggtggttcaccagattaggagttggagaccagcctggccaatatggtgaaacctcgtctctactaaaaatacaaaaattagccagatgtggtggcacttgcctgtagtcccagctactcgggaggctgaggcagaagaatagcttgaaccagggaggcgggggttgcagtaagccgagatcacgccactgccctccagcctgggcaacagagtgagactccatctcaaaaaaaaaacaaaaaacaaaaaaaaaactgaagctcagtgggttacatggtaggtaagggctggagccaggtgttaaacccatgtatctgttaaaattaaaacttaagacaaattaaatttaagagagtttaattgagcaaagaacaattcacaaatcaggcagctccctgaaccagcataggttcagagaaactctggggctgccatatggttggataataattatagacggaaaaaggaaagtgacatacagaaaatggagatgaggtacagaaatagccagattggttaaggtgtggcacttgccttatttgaacatggtttgaacagttggccacttgtgatgggccaaaactctgtggttggtataagagaaggttatagtctatttacatgtccagttaggccactaggtgaggagaaacctttaggcctaaattaaaatatgtaaggaggcagctttaggctaaacttaatttaacaattctcttggccatgcgcggtggctcatgcctgtaatctcagcactttggagggccaaggcaggcggatcacctgaggttaggagttcgagaccagcctggccaacatagtgaaaccccatctgtactaaaaatacaaaatttagctgggtattgtggcaggcgcctataatcccagctacttgggaggctgaggcacgagaatggattgaacccaggaggtggaggttgcagtgagccaagattgtgccgctgcactccatcctgggcgatagagctaagctcagtctcaaaaacacaaacgaaaacaaagaaaaccaattatctctttttggccaactttcaattttgagagattgataaaaagctttaggcattgatgtcactctgtcaccaccgtgaatggacttttttggtctaaaatcccactaggaaacatagcagtgggttttgtaaggtgggaataaggaaatagagcaataaggaaaaacctcgttattccaggttacttttttgggatgggttggagcagaggggagcttcttattatgctggaatttgttttcaggaggaaaaacctggtctgttttgggatctctctgctttctttgaagtttgagtttgattatgtagcatttagcatgggtgactccattttggtttggtcttttggggtctagttcaggagctcaggccagaaaaacagcctcccataactttacttaacatctctttataacattctgtccacaaatgcttggtacgtggctataggtttctggcttaaaaaatgattaacaatgtacccttacctaccctgaatctgagcccctgcagcctctctcatactactgtggccacccaagctgccctgaggtttcccaaccaaggtggctcacatccgtattcccagcacttgggaggctgacgtgggaggatcacttgagcccaggagttcaagaccagcctgagcaacacagtgagacttcatctctacaaaaagtaaaaatgcaaaaatttgctggggggtggtcccagattcttgggaggctgaggtggaaggatcaatagagcccaggaggttgaggctacagtgagctgtaatagtggcactgcactccagcctgaggtacagagtgagaccctgtctcaaaaaagaaaaaaataaataaaagtgaataagaaagcaaagaaaacccaatacaaaccctgcaagaagagagacagagaggtgaggaaagacaaaggaggaacggttcatagaagtctcgttgtagcctgggcccaaggtgctgtattcattggataaccatccacggatgcttactctgtaccaggtgtgatgccagatgctgggaatttggagatgactgagtcatggcccctgcctgagaatgagctctcagtttagtggagaaggcttacatgtaaacatataaattatagtgcagggtaattagaaccataatagagtaatgtaggaaacacacagaagccaaagaaaggaatgatgaattctatttgaagaggaggagctgggaggagaagagagctgaggccttcctgtgagaagggtgggtggtggtgcaggctggtggtggtcccctctgaataacctggaggttgccaggtgggcagaaggaggagagcattttaggcagctggagtgtgcatgggcagagttgaagattagcaattgcaggtcactgtgggcggagagcaggactccccttggcaacctggtgaagtcacttctgcccattactttattcattggaacaactaagagtgaacagaaaagcagcgctcatgccgtcagacccttcttccaaatgaaaacgtgcaccaaggcccagtgtataaataggaagcagataatgtttttttcttaacaggaaacagatctcccactgtttggaaatatattttgaaactttttttttttttttttgagacggagtttcactcttgtcacccaggctggagtacgatggcgcgatcttagctcactgcaaactccacctcctgggttcaagcgattctcctgcctcagcctcccaagtagctgggattataggtgcctgccaccatgtctggctaatttttgtatttttagtagagacagggtttcaccatgtttgccaggctggtctcaaactcttgacctcaggtgatctgccagcctcagcttcccaaagtgctgggattacaagcgtgagccaccgcaactggccaaaacatttttattattttattttatttatttatttatttgagacacggtcttactctgttgcccaggctggagtgcaatggcatgatcataactctctacagcctcaaactcctgggctcaagcaatcctccgacctcagtcctccaagtactgagactgcaggtgtgtaccactatgcccagctaatttttttttttttttgagatggagtctcgctctgtggcccaggctggagtgcaatggtgcgatctctgctcactgcagcctctgcctcccgggttcaagccattcttctgcctcatcctcccaagcagctgcagcagattacaggcatccaccaccatgcccggataatttttgtatttttagtagagacaaggtttcaccatgttggtcacgctggtctcgaacttctgacctcaaagatctgcctgccttgccctcccaaagtgctgggattataggtatgagccacagtgctcagccctcaaataatttttttaaattagttttttagtttttgtggggatgggtggggggggtcttgctatgatgaccaggctggtctcaaactcctggcctcaagctatcgtcctgccttggcctcccaaattgctaggattacaggcatgagccacaggtgtcggaaaccttctggatgggggtggagaggcagatccccaccacaggtctgaaattgcatcaaaactttgaaaagagggcaaagctgcttcacctgagagagggaggagctttcaggggaattctagatgggaggggagaaggtcacaccacatctgccatgcctgtctccactcttaccctgcccaagtccctcctccactttatcaaaatcaggagagagcaatccttctaaaatgcaaatatgagcatgtacccctctgttcaaaacccttccatgtctcccctcactgtgagaaaagaagccaaactcctccaggccgggcgcggtggctcacacacctgtaatcccagcactttgggaggccgaggcaggcggatcacgaggtcaggagttcgagaccatcctgccaacatggcgaaaccccgtctctactaaaaatacaaaaattagctgtgcgtggtggcgcatgcctgtaatctcacctacttgggaggctgtggcaggagaatcgcttgaaccagggagtcagaggttgcagtgagctgagattgcatcactgcactccagcctggtgacagagtgagactccatctccaaaaaaaaaaaaaagccaaactcctgaccacacctctcaggctctgcacactctgcccactggctgctgcccaggcctcacaggtcggcttccctcatttccctccagccaccctcctctcttcattatttccaaattcatcacactttcagcttgttatctatggcagataacctcattatggcagaaaataagactgaagcatgtgaccaaacatagacagactttttcacaagatagtcagtctcttgggcttattcaaattccaaagagaatcatttacaagttaattcctatctttcgggtccattcatttctccttttaaaatattttttttttgtttatttatttatttattttgagacggagtctcgctctgtcacccaggctggagtgcaatggcatgatcataactctctgcagcctcaaaatcctaggctcaagcaatcctctgacctcagtcctccaagcactgagactgcaggtgtgcaccactatgcccagctaattttttttttttttttgagacggagtctcgctctgtggcccaggctggactgcaatggtgtgatctctgctcactgcagcctctgcctcccgggttcaagcgattcttctgcctcagcctcccgagtagctgggattacaggcacccgctaccgtgcccagctaatttttttgtgtgtgtttttagtagagatggggtttcaccattagccaggatggccttgatctcctgacctcatgatccgcccgcctcggcctcccaaagtgctgggattacaggcgtgagccactgcgcccggctatttttttgaaacggagttctgcttttgttgcccaggctggagtgcaatggtgcaatctcggctcactgcaacctccacttccctggttcaagcgattctcctgcctcagcctcccaagtagctgggattacatgcatgtgccacaacacctggctgatttttgtattttttagtagagacggggtttcaccatgttggtcaggctgatctcaaactcctgacctcaagtgatccatccgcctcgggctcccaaagtgctgggattacaggtgtgtgagccactgcacctggccccattcatttccccacaaaatcacatactacctctcaacattgctgcacccccatttcccctcccctgtgaagaaggcagctacataagcatctggaccacgttgggttattaggtcatcgttctcctgtggtttccttatgcttgtacatgtgacataaattttgtacacatttttctcctattaatttgccaattgtcagttcctttttggggagcctttatagggctagagagcagaaaggaagctttcccttggccctacagctccttgaggtcggctgttgactcttttcttcattgctgtctcttcagcgtctagaatggtacctccaatgtagagatgcttgataaacgtgttgagccgggcacagtggctcacgcctgtaatcctagcactttgggaggctgagggtggatcaagaggtcagagttagaaacaagtctggccaacatggtgaaaccctgtctctactaaaaatacaaaaattagcaaggcgtggtggtggatgtctgtaatcccagctacttgggaggctgaggcaggagaatcgcctgaacccgggaggtggaagttgcagtgagccaagaaagggcagcagagcaagaccccatcttgaaaaaaaaaaaaaaaacaagcaaacaaaaaacaaaaacaaacaaaaaaacatgtgttgagttgctttctgtttagtagcagaaagctctggaagggctttggacattcacgcgtgcaggcccgggaacgggatgaggtttaaggcaacttcatctagagtttaaaaggggcaggtaggcccacagctggcacgtgggttaaatgtaaagtggctcaaacaggatctgataaggcagaagcagagatgggggcctggtgtctcactgccttcacgttcttccttctgcctcagtccccacatgagagtgcaccctagaggtgccagcattagcgatagggcagctttccttgtttctgggatggacagaaaatgggccttgagacccctcccatcataggaaagcatctcttgcactctggagactgaggacttgctatagtggaacaagaagcagtcttcggcaatggaggagatgctggatctccatacaggcagggtgggtgcaacggagtggagctgtggcaaatgtgggtgcctctgtcctgagggtcctggatgtgtcatgcctgggaacatgagggcgttcttccaaggtgcccatctcgacctctctgagctgccatctttgacttcctgtgtttggtcacagactaggggtggtctgtccctaaacagaagaagacaagcaaggattagagaggagaaagagctagagagagagcttgggagagatgtagggacaaggaaagaagaggcagaaggaaaaaggcatggagggaaggaatataaaaaaaaaccccttaggccaggcatggtggctcacgcctgtaattcccgcactttgggaggccaaggtgggtggatcacctgaggtcatttcaagaccagcctggccaacatggtgaaaccccatctttactaaaaatacaaaaattagccaggcatggtggtgggtgcctgtaattctagctactccggaggctgaagcaggagaatcgcttgaaccctggaggcagaggttgcagtaagctgagatcaggccactgcactccagcctgggtgacagagcgagaatctatctcaaaaaaaaaaagaaaaaagaaaaaaaggccgggtgtggtggctcacgcctataatcctagcactttggggggctgaggaaggtggatcacaaggtcaggagattgagaccatcctggccaacatggtgaaaccccatctctagtaaaatagaaaaaattatctgggtgtggtggtgcgcacctgtagtcccagctactcaggaggctgaggcaggggaattgcttgaaccctggaggcagaggttgaagtgagtcgagatcgcgccactgcactccagcctggcaacagagcaagactccatctaaaaaaaaagaaagaaagaaagaaagaaaaatcctccccagagcagggaaagatgaagacataaagggaaggagagtcaccaggaaagagagagggagagagacacaaaacaaaatggctggaatgaggtgaaagttatagtagcaggatgtgctgacactgaccttggagaaaaagagaggggaagggaggagtgaacgtggaatctttggctgctgttctgtttcactcccagaactcaccaccctggattccccccatttccagatcctcaggcgggactgcctttgctatctgggatgagtcattggccccagatggtaaacctgtgaggggtggggtgctctgaatgcctgactagtcatttataattgagagcacttattccagccccttctggtcctccatccttccctcttcttggacctcctgattcagagaggtcagagggccagtccaggaggggtcaggcactaggtccctggagtcagtcttagggattttaggcagagaggaatcagtcctgaaaatgaagggcatacagagaaaaaaaaaactatgacatcacccctgggggtgttacagacctaagaaagaagcaatggccctgggcggcctacagccccaggaagattcagccatggtacccaggagacttgagggcccaaagcccagaattacccccagaggaacacctgtagaccttcggatccttagctttgcacttcccattggactgactctgtttcctgtggggcaataggcacgtgttcactgtgcacctgcagccccagtcatccttctcagagagaaatggtttgggaagtgtttggcatattggggataaatagatgagtggatagaaaaaaaaatgcaggccaggcacagtggctcacgcctgtaatcccagcactttgggaggccgaggtgggcggatcacgaggtcaagagatcgagaccatcctggcaaacatggcgaaaccctgtctctactaaaattacaaaaattagctgggcgtggtggcgcatgcctgtaatcccagctactcgggaggctgaggcaggagaatcgcttgaacctgggaagcagagattatagtgagccgagatcgcgccactgccctccagcctgagggatagagcaagactgtgtctccaaaaagaagaaagaaaaaaaagcaattacagcaaaatattaaccatagtagaatctatacagtggttatataagtgtccactatacaattctttttttttttttcctttttttgagacttgatgtttcgatcatggctcactgcaactttgacctcctcagctcaagtgatcctcttgcctcagcctcctgactagctgggatcacaggtgtgcaccaccatgcctggctaattgttttattttttgtagagacgagatctccctatgttgcccatgttggtcctgaactcctgagcttaagcagtcctcctgctttgacctctcaaagtgccgggattacaggcatgagccactgcacccagtcttgctatacgattcttttgttttttttttttttttttttgagatggagtctcactctgtcgcccaggctagagtgcagtggagtgatctcagctcactgcaacctctgcccctcaggttcaagtgattctcctgcctcagtctcctgactagctgggatcacaggcacctgccatcacacccagctactttttgtatttttagtacagatggggtttcgccatgttggccaagctggtctcaaactcctgacctcaggtgatccagctgcctcagcttcccaaagtgttggattatgggtgtgagccactgggcccagccactgtacaattctttaaacttttatatgtgtttggatttttcataatattagaaaagggaaagaaaaaaatgtctggcaaatagtcagcactcgtaagtataagattttgggaatatattcccttctgggagaatccacatttcgaatgcctgggaagggctctgtttgtcctgacagatggcagatttcaggtgagagcacctactaagcctagaggtgataagctactttgcccacctagagctgctggtggtgaccttaagtttactatgtttctcctggtatacggcacttggcccagagtggactccagcttgccacctgtcacccaggctggagtgcagtggcgtgatcttgtctcactgcagcctcaacgtcctgggctcaggcgatcttccctacctccctcctgattagttgaggctacaggtgctcgtcaccatgcccggctaatttttgtttttgttttttgttttggtagagatggggtctcacactcttgcccaggctgagctagaactcctggcctcaagcgatctgcctctgcctcccaaagcattgtaatgacaggtgtgagtcaccatgcccagccaggaactcagagaatcttaccctatgctgtagtatctgttgactatggggtagaggcaggataaggtgttccagaccctgcctgacacctgatccgaagaggttgctcatgtttgctcaggaggtgaggttcacacaataaagggcaggaggagggcttggacctggtataaaacatctggaagtttccagggggctgctttgcatctgaaactgtcaggtgaggggtgacagagatgcctgaatctgagttgggggggaattcaaatctgagctggcgaagaggatgcctggaaggaatggcaggaaagacttgagttaattggcgcttctgggtctgcagtaatcttaggtgcaaagctgtctaggtctctgctgaaggactggggacacctgggatgttcaggagaatagaaatggccagatgtgtgttagtggagaaaagaatagtgacacatagaccaggcacctggggtctaatatcttgagctggtcccgactccttctgcaacttctctgtctgtcctagttccaccagcactgcttggatactggtgctggcacagttccttctgtcaccaactttgctccccaggtaacatagaggcaactctaaaatgcttctttccttgagaccaggtggatgccagggatttaaaccatgctccaggtgccccataatccaggccaattcaccacagatgatgaggctttctttgctcagcctctgggctcagtaaactcagccatctctttgcttgggagaggtcctctactccctccttagaaaactcgtttcctggctatggccataccaacccaaatgtacctgggcttggctgacttcagaaaacttttctgctttgtgccaggatggaataaggcttaatccagatagttagagttcatcttcaggcctgagagaaaaagaggagggcttggctacagccagaccagggagagctggaggggtcagggacattgaaggtagcatcagagaggaacaggactacaggctatggacagtcctttctaagctcaagactgggtctgctaggtctaagttgaaggacgaagaaggcttggtctgagctgcaggtcaggagtgcctgggtcaatcaagtcaacaaggaagaaggtgaatcttcatttgctcttttcttcccactccagccccagaatgttgacagtcgctctcctagcccttctctgtgcctcagcctctggcaatgccagtaagtgagataccaggagcctggtattggggacttgggaaggcagccttgggcactgctgttggccaaggcttttggaggttggcttggggtggggagctgagttgtcggaggaacaggggtgatgcagagaaactgaactcctggaagatttctccctccaactcctgcttgcccctccagttcaggccaggtcttcctcctatagtggagagtatggaggtggtggtggaaagcgattctctcattctggcaaccagttggacggccccatcaccgccctccgggtccgagtcaacacatactacatcgtagggtaagattctttgaattcctggctgggcgcggtggctcacatctgtcattacaatgctttgggaggcagaggcagatcgcttgaggccaggagttctagctcagcctgggcaagatgccagggatgccagggatttaaaccatgctccaggtaccaagaccccatctctaccgaagaaaaacaaaaaaattagccaggcatggtggtgagtacctgtagcctcaactactcaggagggagaggcgggaggattgcctgagcccaggatgttgaggctgcagtgagccaagatcatgccactgcactccagcctgggtgacagagtctctttgttggcaaaatgagttgaagttccctgtaggatcttccagggttcacccaggcttcacagtctgtaggactagccagagacctctcatccctatcatcacctttctttctccttccttcctcccctcttcctcagtcttcaggtgcgctatggcaaggtgtggagcgactatgtgggtggtcgcaacggagacctggaggagatctttctgcaccctggggaatcagtgatccaggtttctgggaagtacaagtggtacctgaagaagctgttatttgtgacagacaagggccgctatctgtcttttgggaaagacagtggcacaagtttcaatgccgtccccttgcaccccaacaccgtgctccgcttcatcagtggccggtctggttctctcatcgatgccattggcctgcactgggatgtttaccccagtagctgcagcagatgctgagcctcctctccttggcaggggcactgtgatgaggagtaagaactcccttatcactaacccccatccaaatggctcaataaaaaaaatatggttaaggctagtctgtgtgggggcatctgtggctgggatatctgcctcctgacttagccggggacgtgcaaatctcacttctggctggctttggacatctgtctggaagatgggaagatgagggagaggtatgtaagaatcctgggctttgtgctataatttatcaagaggagatgagattctggcttgcatcaacgctcttcaaggacagctccttggaacattgatccaaactggagtcatgggtctgagggcaaggcctagttgtggcttacaccaaaaccccagatgtcccactctccagctctcctcacccctggtcctccccttgagaaagtggtgaactcacttgctgtgtgtgggtggccaggaccattagcctttgttctttcccagaacccacctgactcctgaaacttagctgaagtctgtgcccgaggaccctgccctgttaccaggcccagttcctcctcacctctacccatgagccccggtgtcctgctaagccctctcagatctgggattcctccttcctcaggaagccaccaccttctcagcagtggaaaccctgcccacactatgctcttaggctttagccatcagaaggttacagtggactgcgggaggctgacactaggctgaactcattaaggaatgaatgggaggtgagaagacacaggcagcaagaatcgagtgtttcaagaagtttggctgtggtttgccagaaataggcaagtcagttttcgggggtgtaaggaaaaagggttttgtgtctttttaaaatcctagacaggagagtcacaagcatgttcacatgataaagaggaagaaagagaaagaggctggagattctgaaaagagatcactggtgaggtctcaaaagagatagaagaggatggttatgtagttggggaaagaaattttaagaagggaagaaaattaaaatgagtgaaggtatacgttagttttgtaaaagttatcaatatctggctgggcacagtgctcacacctgtaatcccagcactttgggaggccaaggcaggcagatcatttgaggtcaggagttggagacaagcctccaacatggtaaaaccctgtctctactaaaaatacaaaaattagccaggtgtggtggcagtcacctgtaatcccagctacttgggaggctgaggcatgagaatcacttgaatgctggaggcagaggttacaatgagttgagacagcacaactgcaccccagcctggatgacagagtgagactccatctaaaaaaaaaaggaatgttatcagtatcaaaatggagtaacatatgtcacatcctaacaaaatggaaccaacctgacacctaaattaagcattgcacctgataacaccatggaggactgggtggagaatcagcagacaatggcagggagaggcagtctgtggaccaagttcaggtgaaaggatcacccatcatgttgggcatcagatcaggcaggttcacacactacctgaggaagctggtctttgtgacagacaagagctgctctgcctcttgggaaacacaggcaccagttttagtgccatcttcttgcacccaaatgctgtcctttaactcatcagttacagtgctggatccctcatcactgccaatacggggctagcaatatgtctgccccagtgaatgcagccgccacggagccccagcctcctctatggcaggggccctgtggtggggaatgaggacttctctatcattaacctccatgcagttggctcaagaaaaggatatggtagttgggcaagggggctcacacctgtaatcccagcacacttgtaatcccaggagggtcgcttgagcccaggagtttaaggccagcccgggcaacatagcaacctgtttgtaggcaaaatgaggagttgaagttccccgtaggatcttctagggctcaaccagccttcatgtgcagtgggactggcaagaaatctgtcatccctgttaccactttgaaggtctcagtgtgtatgcaggtcctgaaaagttcaagtcccacctgaaacgcaacacagcatcatgctctgattcatcagtgattccctaatcaatgccattggcttgcattgggactatctatcccagcctatccagtgacttcagcagctgcagagccccagcctcttctttggcaggggcactgtggtgaggaggaaggattcccttatcacaaatctccatccaattggttctataaacagatatggtggcccaactgttgcgggaagtcagggaccccgaacggagggactggctggagccacagctgaggaacataaattgtgaagatttcatggacatttaccagttcccaaaattaatacttttatactttcttatgcctgtctttactgcaatcactaaacataaattgtgaagatttcatgaacatttatcagttcccaaataatactcttataatttcttatgcctgtctttattttaatctcaatcctgttatcttcataagctgagaatgtacgtcacctcaggaccctgtgatgattgcattaactaacaaattgattgtaaaacatgtgtgtttgaacaatatgaaatctgattgtaaatgtgcatttgaacaatatgaaatcagtgcaccttaaaaaagaacagaataacagtgattttagggaacaagtgcagaggttacaatgagttgagatagtgcgactgcactccagcctggatgacagagcgagatttcatctaaaaaaaaaaaaaaaagaatgttatcagtatcaaaatggagtcacatatgtcatatcctaacaaaatggaacaaaaagggaagataaccataaggtctgactgcctgcggggtcgggcaaaaagagccatatttttcttcttgcagagagcctataaatggacgtgcgagtaggagagatatcgctaaattcttttcctagcaaggaatattaaatattaagaccctaggaaaagaattgcattccttggaggaggtttacaaatggccactctgggagtgtctgtcttatgctgttgagataaggactgaaatatgacccggtctcctgcagtaccctcaggcttactaggattgggaaattccaacctggtaaattttggtcagaccggttctctgctctcgaaccctgtcttctgttaagatgtttatcaagacaatacatgcacagctgaacataggccctcatcagtaattctaattttgccctttgtcttgtgatctttgctttgccctttgccttgtgatctttactggcctcagaagcatgtgatctctgtgacctactccctgttcgtacaccccctccccttttgaaatccttaataaaaacttgctggttttgcggctcaggtggggcattatggacctaccgatatgtgatgtcaccccccaccagcccagctgtaaaattcctatctttgtactctttctttttatttctcagaccggccaacacttagggaaaatagaaagaacctacgctgaaatattgggggctggttcttctgatacccaacaccatggctcacagctgtaattccaacacttccagaggccaaggcaggaggatcacttgaaccttggagtttgaggttgccatgagctatgattgtaccagtgcactccgacctgggtgacacagtgagaccttgtctctaataagaagaaaaaaatgccattttaaaagtgtacactttcatggtttttagtatattcactgtattgtacaaccattaccactacctcattccagaacacttccaccacccccaaaagaaagcagttacatctgttcactgtagtgccaattactcaaccccttgtcatcccctggcaaccaccactcaggtgtactttctatgtctgtgggtttgctattgtaatttgaaagttcactgatgttactttaatttggtttcattttgaatacagtaaatatggatcaaaacccatatatacggagcatctttagaggcctcatttttgtttttttttttttttttgagatggagtcttgcactgttgcccaggctggagtgcagtggcgtgatctcggctcactgcaacatccacctcccagattcaagcgattctcctgccccagcctccccagtagctgggaatacaggcgcctgccaccacaccctgctaatttttttatttttagtagagaggggttttcactatgttggccaggctggtcttgaacgcctgacctcgtgatgcacctgcctcggcctcccaaagtgctgggattacaggcgtgagccaccacgcccaggctagaggcctcattttttaagactaatgggatcccaaggctaaacgtttgagaaacactgatctaagatttgtgttttgttttgttttgttgttcaatcaagtggaacataatgtctaaaccagggccttacctacctggaactcaaaggtggaatgaccttccctggccaagcttccagaagggacagggagctacttaacagactgctggacccttaacgactggaaaccggaaccgtgggtgacggaaccgaccagacgtgacagccctttggctggggctgcagtcccacgatccacacaacgactctggctccgcagacgcgccaaccacccacggaggcaagaaactgccgagagtgaagggaaagggagcccagtgctgggcggcactcagcagctcccccagcggccactgtcgccaacgtctccgcgtcggggtttgtaccgcagctcgcgtccagtcgtcaatggctgcgaggcccatgcgcgctccagcgtcctgaccaggggaacgttttccttagggacccggaggcgagcgctggagggagggatggttgctaacgcaactctctgcagggcagacccaccagcacccgcacgcaaactacgggctggagcagtctaacagaaactctctcaaagtcgctcacgggttgccattctaggtaagatttgtgaataaaactaattctttaaaagcctgagtttttctttagttgacagttttaattaacatactcttttctttcctcttctgcagacccagcctcaccattccaatgaagacatcaattaacccatgcacagccgctacaaacggggagctcattgcctgcagggaaggaccctctacagagagctacctgggggctgggaagcaggaccccaggctgagtcctgccttttggtagtgccccgccccggccaatgcggctgttatatcaaagtacataaaagtgaaggcaaagggtgtccacgtgggatagactggcatagcttcctggccacccatggtgctccattatctcttcgaggaccccttctccacgagaccctccaggtctggtcctctatcgtccagcccccattctcttctccatcactgctgctgtgtcccagatgaccttaatttaatcttcacatatttgaaggacagaatcatcggcctcacccactaattattattattattattttattttattattattattttttgagacggagtctcgttctgtcacccaggctggagtgcatcactgcaagctccgcctcccaggttcacgccattctcctgtctcagcctcccgagtagctgggactacaggcgtccgccaccacgcctggctaatttgttgtatttttagtagagacggggtttcaccgtgttagccaggatggtctcgatctcctgacctcgtgatctgcccgcctcggcctcccaaagtgctgggattacaggcatgagccaccgcgccaggcctagacccactaattatcttttatggcacaaactctatgttttacttttgcccaggctggaatacaatagcggcatgatctccgctcaccacaacctagcctcctgggctcaagtgatcctcccacctcaacttcccaagtagctgggagtacaggcatgcgccaccacacttggctaattttaaaatgttttgtagagaagggtctcactaggttgcccagactggtcttggactcctagacccaagctatcctcccaccttagcctcccaaagtgctgggattacaggaatgagccactacatctgacctcctttgcttcttttaaagacatagtttggaatttttttttttttttttttttttgagacagagtctcactctgtcgcccaggctggagtgcagtggcgccatctcggctcactgcaagctccgcctcctgggttcacgccatccttctgcctcagcctcccgagtagctgggactacaggcgcccgccccacacctggctaattttttgtatttttagtagagacggggtttcaccgtgttagccaggatggtctcaatctcctgaccttgtgatccgcccatctcggcctcctaaagtgctgggattacaggcgtgagccatcgtgagcagcctttttttgaggagtctccaactgtcacccaggctggagtgcagtggtgccatctcggctcactgcaagctctgcctcccgagttaacgccattctcctgcctcagccttccgagtagctggaactacaggcacccgccaccacgcccagctagttttttgtatttttagtagagacggggtttcaccgtgttagtcaggatggcctcgatctcctgacctcatgatctgcctgcctcagcctcccaaagtgctgagattacaggcgtgagccactgcacccggcctggaagttattttttaaaaatcaattgtttctttctctgtcatcccagcaggagtgcacaggcatgacctcagctcactgcaacctccacttcctgggttcaagcgatcctcctgcctcagtctcccaagtagctgggactataggcacatgccaccacatctggctaattttttttctttcagatggagtcttgctctgtccctcaggctggagtgcagtggtgcaatctcagctcactgcaacctccaactcctgtgttcaagtgattctcctgcctcagcctcctgaatagctgggattacaggtgtgtgccaccacgccggggtaatttttgtgtctttagtagagacagggtttccccatgttggccaggctagtgtcaaactcctgacttcaggtgatctgcccgcctcagcctcccaaagtgttgagattacaggcatgagccaccacgcctggccaaaccaccctaatttctaccagccagatgcagatccttaaaacaaccctaggaggtatttcaaccattattcccttttaatatctgaggaaatggaggcacaaagaggctaaatctctggtctgggcagcctggcaccaaggccctgtacctaaatggtttattcaaacatagaagccctatctccttgatctatgctcttttcactatttctggcaggtttcttaccaaatatctggagttgacaacaaatgtgaaaactgaacagccttttctgacaggcaaggaagaccaaactgccaattgccaatgtcagatgttctcaaagtatggtccagagacttctgggagtccctgagacactttcagtgggtctacaagttcaaaactattttcataataaaactaagataccaattgacttctcttgcattgtttctcaagtatatagtggagtattcaaaatactatattatatgtgacatcacaacagcatgaatgcagaagcagatatgagaatctagtttttttgtgtgtctttgagacaaggtctccctctgtcactgaagccagagtgcagtggcaccatcacggctcactgcagcctcaaactcctgggcttaagcaatcctcccacctcagcctcccaagtagctgggaatataggtgtgtgccaccatgcctggctaattttattttttaagagatggaggtaggccaggcacagtggctcacgcctgtaatcccagcactttgggaggccgaggcgggtggatcacgaggtcaggatatcaagaccatcctggctaacacggtgaaaccccgtctctactaaaaatacaaaaaattagccgggcgtggtggcaggtgcctgtagtcccagctactcgggaggctgaggcagaagagtggcgtgaacccgggaggtggagcttgcagtgagccgagatggcgccactgcactccggcctgggccacagagcgagactccgtctcaaaaaaaaaaagagatggaggtctaggcagggcttggtagctcacgtctgtaatcccagcactttgggaggccgaggcggatggatcacctgaggtcatgagttcaagaccagcctgaccaacatggagaaaccccgtctctactaaaaacacaaaatcagccatgcacggtggtgcatgcctgtaatcccagctactcgggaggctgaggcaggagaattgcttgaacccaggaggcggaggttacggtgagctgagattgcgccactgcactccagcctgagcaacagagagagactatgtctcaaaaaaaaaaagtgcacacctctctggtttttagtatgtttattacgttacgcagccatcatcactacttcattccaaaatatttaatatttccatcacccccaaaagaaactcgttatatctattgctgtagtgccagctcctcagcccctcaccatcccctggcaaccactacttagatgtcctttttatgtctatgggttttttactgtaatttttaaattcattaatgtcaactttaatttagtttcacttcacacacagtatatacggccaggcctggtggttcacacctgtaatcccagcactttgggaggccaaggcgggtggatcacttgaggtcaggagtttgagaccagcctggccaacatggtgaaaccctgtctccataaaaatacaaaaattagctgagcgtggtggtgcacacctgtaatcccagctactcgggaggctgaggcaggagaatcacttgaacccaagaggcagaggttggagtgaaccgagattgagccactgcactctagcctgggagatggaagtgaaaccccgtctcaaaaacaaaaaaacaaaaaccctcatatacacaaaacatctttggaggcctcatttttaaaaactgtagtgggatcccaaggcaaaacgtttcagaaacactgatctaagatttgtgttttttgttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggtacttgagcccggcctgggcaaggcgggtaccgacgtctggagtttagtgggagttatgtgtcggagtgtggtccaggctctgcgggttgtcgcggagaggcggccatggcgcaggggcggggagagggggacggtgagagtgtggggtcgcgagccggtcgccccgcctggctcctgccttctccctgtttcctgctctccccttgggtcagtagactcgggtctccggtccaggctcttggcttgaaccccgcgcactttttctttgtgagcttcggtttcttcgtctgtgaaacgggggtcatggcctcatccctggagatcacctgaataagcaagagaagagtggcggacgctctagccacgaggacgagaagaagggagccggaggcgtgtattgggaagggttctgtgtgggacatggtgtttgggtgcagagacatccctgagagatgcaagaggacgggctgaggaacagacccggctgctgctgggtttgagttggcagcgtaagatgctctgcgattacaggaaaacgaaataaaagactaaaatttcctttcactctagcatggaagtgaatgctattttagggttggaaaggctgttaggacacccaaaatcttgtatgtgagtatttgtttacatgtgcctctctaacccggagacttaatcctcgttagtgatgatggtgagcgccatagtaattcactggagccctcgttagcctcgtggggaaacagacatttaggagaatgcctaacacatgtagagctcttgctatgtgccaggcacagttgtaggcattttatggtggtgaaccatttattgtccacacaatgctatcaggttgttactattactgtctttgttttacacaggaaactgaggttagtttgttcagagttaacacaactagtaaatattggggcttgaattcgctctcaaggagtctgagtgtagaacctctgctcttaaccattatgcccaagtacatgttatccctgctggctgagcacagtctccccttacccttcgaagatgcactgtgtccggtgcatggtagatatgaaaatgcctgaatgaataatgtcccttcctcgaggaatttacagtctgtttcaatagagtgtcacatacgtagatgtaatacgaaacacaatgagagatgtgtataaactgagggtgtggaatctgaagtaagcccttgagtattctgggaggacttcattaagggagtgaatgatacttgagatgggtttcaaaggttggataggagtttgccaggccttgactaagaagacaagaacagcaagtgttttcttatttatgatgtaagatgctctcttagctcaatttcctcatcaataaaagggagaagagtgaatgaaatttaggaattgtgaaagaagggaaaattaataattgctagcctggtccaagctcaaggttgcttttatcatgaaagggctagactcttgtgcagtaaataattgtttacatgtggccctcccctcttccctcctaccctggactgtgagccctggggcaggaatggccgtgagccattttcatgatggaaatgaacaagccagtgattagtagtttattcactaaatcttaatttttttcagcaaatacttcttgagggcctactctgcgccaggtgttggggttagaaaggtgagcaggataaaacttgttctcacagttggcagtcaggtggagaaagtgacaaacacgcaatagtggggtgtgacaaatgcttatggaggggctaacatgagctgtggttgcacctgataaagccttagtgtctaccaggaaagggtttttggttttgttttttaagaggagttaaaatgtgtttaccttagtcactccagggtggggtggggagcaatgcagatattctagggagagagattaacgtggacaaaaatccaaaggtgcaagagaacttggagttttgtaggaagtgaaggaaattcatcatgactggtaacttacactgcaaggaaggaaacagagggaatgactagagggcagggagacaccttgctaccaccagcaaggaaggctgtaaagaccatgaccttgggcagaggtagtgcagtgggagtggagagaagtggacttgttcaagagagatttaaagagatagacttgacagatgttaatgatgaactgatgtgggaggtaagagacgttggagttaaagactcccacttttggggttggtgccattcatttacatcagagatcaaaggaggaggctgcagagagatggggaaggagggttcagtttaggacaggtggagtttaagaggagccgtcggctgggctcacgcctgtaatcccagcattttgggagaccaaggtgggtggatcacgaggtcaagagatcgagaccatcttggccaacatggtgaaaccctgtctctaaaattaatcaaaaattagctgggcgtggtggcgtgcacctgtagtcccagctattcgggaggctgaggcaggagaatcgcttgaaccgggaggcggagattgcagtgagccaagagcgccactgcactccagcctggcgacagtgagattctgtctcaaaaaaaaggagccgtcagggcagccgttcagaacgtgggctgcagttgagagctcttgtgcagaacgtgcaataggacttatcagctgtaagatgttactgaagccaagagggcgggtgacctgcctatgaaatgaatctgagtggtctcagctcggggcaactttgtccctcacaggacatttggagatgtctggagagatttttagttgttacaacttgagggtgagggtggagaatgctactggcatctagtaagcatatgctaacagtctaaatgcacaggacagccccacaacggaattagccagcccgaaatgtcagtagtgctgaagttgagaaatgctggtctagagaaaggatagacggatcctaggatgaggagtgaacagaaaactaggtaagacaaccaggaaggtggggggcatggaaatgaagggaaaagtgtgtttcccaagagtgtcgcatacttctgggaggtccaacaggattgaggctgagtatgcctactggatctagcactagggaagtcatgggtgaccctgctgaatagtgagggcagaagcaagttgcagggatggaggagtgggtagcaagagaaagggtgtaataataacagctaaggactgagcagttgctgccaggcactgtgctaaacattgtatgtacattattactttgaatcctcacattcttatgagatgcaaagatgaaggggctaaggaggctgaggagggttcatataaagcactttggagttagatcttcatttgaagctgtcagtcactagctgttgaccctgggtcagtcagctaacccctctatactgaggtttcctcatctggaaaatgggagacggacattaaaaagcacttactggcctttcaccaaataccagataatgttctaagcacttttacatgaatcaccttaattactctcctaacaacctaacaaagaggtatttttattcccattttgcaggtaaggaaattgaggcactgggatggaaaataatttccctaggttacttagctagctgtaaatggcagagctgggatttcaacccaggccattttaccttgaatgatgaacctacctactatgtgctagtcactgtgctgccactttatctggcacttatttcaattatcttttttttttctgagacacagtcttgctctgtcacccaggctggagtgcagtggcgcaatctctgctcactgcaacctccacttcccgcattcaagcaattcttgtgcctcagcctcccaagtagctgggattacaggcgtccaccaccatacctgactaatttttgtatttttagtagaggcagggtttcaccaccacgctggtctcgaactcctgacctcaggtgatctgcccaccttggcctcccaaagcgctgggattacaggcatgaaccactgcgcccggccaaattctcaaaaagcccaaggcccacccccaaccttattttacagacaaggaaaccaaggtccaaggtcacaagctaataaatgtcagagctggaattgaagtccacttctgtctgaccagagtctacactctacctcattactgacttccccttccccttagattgatcactgcgcttccttaagtgcttctacatctgccatctttctgttctcccaaaacatcctgtgaaagcaggcagaggaaggtcctgcacatatttttgacaagtcagtgcacctcagttttctatctgcacacatgcatctgcaggtttttacctgcttgctcctgactttcaggattgccatgaggaacaaatgagaactagatgtccaagcgctttgctaccataacgtgagaaatggtattagtagccccatttatcagatgatggaatggaggttcagtttttgaaacagcccgtctgcttatgggcatgccttacttaggtgtaagattctttgtaggggtcatctgtctgccttttcgtcttgctgtttctgtgttggctacgtataccagccagccttttgccttctgcgaggcctatggctcctagcaaccagctgctaccaccagcaaggaagggaaagagctgccaggagctttcccagttggtacataataaggaagcaatacagcatcctattaaaagcagatttttagaggggaagagatctaggtttgaattccactatgagctacagtatgttatcctccaacgtaaaatagagtaatactctccttagatattttcagctcatttaacccccacaaaaatagagggcttttctttttttaagttttatcttcattgtgttttctgatgataaaaataattcagttgccaattctaaaacaaaacaaaacaaaaaaaacttaatcatctgaagcaaattcagggttaagtttacatgagagaagaattgcatgtcggtggtttttgcagaacccacataattccccatcaagagaagatcatcattaacagtttgcaggggtgggtgggtctgtgagtatacatacgtctcaatacatattagaaaccccagttaagaaatggaggtacaggctgggcagggtggctcacacctataatcctagcactttgggaggccaaggcaggcagatcacttgaggtcaggaatttgagaccagcctggccaacatggtgaaaccctgtttctactgaagatacaaaaactagccaggagtggtgttggggacctgtaatcccagctactcgagaggctgaggtgggaggatcgcttgaacctgggaggtggaggttgcagtgagctgagatcatgccactgcactccagcctgggtgacagagcaagactgtctcaaaaaaaaaaaaaaaaacacacacacacacacacacagaaaattctggcagttcgctctctggtttaggtttcggtcagatgtcaacccttttaatccttagaacaaccctgtgaggtgctggtctacttcacccttggcaattcaaaacatgtcctgggccaggcatggtggctcctgcctataattccagcactttgggaggctgaggtaggaggatcgctggagcccaggagttgaagacaagcctgggtaacctagtgagactccatccctctctctctcttttttttttttaagtgcccagcatcacctgggagcttgttagaaatgcaaaatctcgggcatcaccccagggagacggagaccaaatccacattttcacaagatcctccaggttatttgtgtatacattacagtctgagaagcctgctatacacctgctgcacttgcttgtagagcagggaaggcactgaggccaagcttaggggtgtccacaacatgaccagggcagaatgagcttctccaacatgagctgtggcccccagcccgcccagcaaagttggtccctgcttcttctgctaccaccatacttcatgtctaaaagtgatcttctctcctccaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtaaggttcaggccactcctcttccctcatgccatcacctccctctcctaggcctgcccacgttcccctgcctccccaggatccttgctccctccttagcaccgctttgttccctgagccttcactgttcacttaggaaatgttgacaggtgcccccatgatgggccctctctgggatactgtagggagagatgagaggttgaatcaaacatacattactgtgcacagagagggaggagcaatgagggtgagcaggtgagccccaagtagaggctgggggacatatcaggagggttggcggaacacagacctgccagccagcctacccaagctgcagctgggtagtgtcagagaagaccacccagatttggggacagaactcagaagggcagctactttataatcctactggggatttaaagttcaaactccttggcctgtttttctaggcgggggctggcaaaccatggcctgcaggtcaaatctgatcaggagtaagattttcagtaaataaaattttatcgtttatttacatattgtctatagctgctttctgactacagtggcagagttgagtagttgtaaaaggaacacatggcccacaaagcctaaaatatgtacaatctgcctttttacagaagtttgctagctcccatactaggccgttaacaatttgggcttcagtttctttccagcctcattccctcaatatatattaaactccctgctgtggcctaagctgcacttctccaccagaacgcagtggataggtgattggtatgtagagtctagttcagtcataagcagcatcctctattttccccattatggtgtaaaatacaatgttctacacatgtagccatttgaaaaagactgggaagccttgcttttttgctattcttgattctcagaatttctttctttggtcaaaatcttccttccttgagcagaatcagttactcctttgagagtgtgttcttatcttcgtttcctaaatcacagcaaagtgtggatatctatcctaccagactgaaaaactccaagagcagggatatcagatctatctctgtattcctaacaccaatagagagatgaggatggagtaggtgttaggtggatgctttttaaggtctttgtacaagaaaggggatagagacgttctcttaaatccaaggtccagatgagagtagaatcccttacccacccccaccccactccaccccttacacacacacacacacacacacacacacacacacgctaatttctttctttcttcctgcaggtttgatgccttctatggggagaggagtactcagcaggacatctatgcaggttcagtgcagcccatcctaaggcacttgctggaagggcagaatgccagtgtgcttgcctatggacccacaggagctggtgagggagccagaaaagaaacagctatgggtcagaaagggctggggaaacggagaggaaaacctcacagttttctccactctcttcccagggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtgaggccccgtgctggttgggagaggagcaacaaagggtcaaagtaagacctggttctagaacatgaagctctgctgtagcagggaggtaaggtgagacctagaaagacagagactggggtagcagatggtacaactccgagaatagaacagagaaaggaaactgatccccaggaagaaacagcctctctatggagaattgcccttccccttcactgcttacacaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtgaggccgcagacaggggcgaggacctgggaagcccaggagcctgagctaagcacgagacctttgttcttacccccaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggtcaggcccacctgtctcagggaagaaggggctgcagaaggaggttctcaggcctgctgtggggtggggaatagcagttgaggcataggaaggctgggcttctgacccacccactgcctggtctcaccctcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatggtgagaactgggggaggcaggagtggaaacgctgggtctggaaattagggagtttgttgaaaccaccaagcatcagcacagaggctgaccacccccaatccctctctccaccccatcctccaatcatctagccttgggacctgttaagctgtctcagaaagaattgcttggtccaccagaggcaaagagagcccgaggccctgaggaagaggagatcgggagccctgagcccatggcagctccagcctctgcctcccagaaactcaggtgagcagtggggccttgggtgtatccccttcctgatgtatggcttagcagcagagctgcaatgcccgtcagatccttgagcagagagctgtgatcttgttcctctcccattaaattcaccctaggccggatgcggtggctcactcctgtaaccccagcactttgggagactgaggttgggtggatcacctgaggtcaggagttcgagaccagcctggccaacatggtgaaacctcatctctactaaaaaatacaaaaagtagccggatgtggtggcatgtgcctgtaatcccagctacttgggaggctgaggcaggagaatcccttgaacccaggaagcagaggttgcagtgagctgagattgtggccattgcactccagcctgggcgacacagcaagactccgtctcaaagtaaataagtgaattcaaccctggctaggcacggtggctcacgcctgtaatcccagcactttgggaggccaagacgggtggatcacctgaggtcaggagttcaagaccagcctggccaacatggtgaaaccccatctctactaaaaatacaaaaattagccaggcatggtagtgggcacctgtaatcccagctactcaggaggctgaggcaggaagaattgcttgaatctgggaggtgaaagttgcagtgagccaagatcatgccactgcactccagcctaggtgacagagcaagactgcatctcaataaataaataagtaaataaataaattccccccaaattctactccattgaatcactaaagtctaagattaatctctcctcagtgctgctgccttggggacctaaggaggcctcctcctggggatcctttccattttccaacccctttagccttcagcaaaacttctcactttgggacagctgtttcaaggatgagcatttttgcttctggttcaaggagtgatctggatcagatctttcagatccatgagagcaaagcaaaggagacttggaagagctgtcctgctgagaccatctggtctgtgtgtcagtgcccagcttctccatgactctccggggagccagctgctgtcctaactgcgtctaccctcaatccagataaagcctctaaactaagtcctttgtgtcacctcctgccccaactccaatcaccccacctcatggcccagtatgtactaatcctcaggtcatctctgttcaggggtcttgctttctgtgtctggccacttagcccttgcgctattccctccaccccccaggagccagttgcagttttaactttgccctgtttctacccctagcccaaataaagcctgtgaactactaaacagaggtgacctgaggtggccaagggttagtgcccactctgtcccagggggctactgtagttaaggaagatgccacacacaagaagatgcttgtgcactcatgaccccatctctcagtcttgtctttcccaaaccatctgtcagcactccccactgctgtgtgcacccagaaatgtgcacaggtaagctgtcagacaggcactctgagtaaggggaagctcagagttgggcacatcaaacccagcagacccagagcttgggggcctcacaggagagcaagtcagatgggaacatcagtatatgataccaggtggagaattcagaatcaggaaggagtagctgctgctgctgtgagagtcaggaaggaagagatgacttctagtgtttgcccacgtatgttctgatcctgtttttccaaggcactagcatggaaagcacaggagtgtccctgtcctccaggagccagttcacagcataggaagggagatgcattgttaagcttggcgtcatgggaaaggtggcatcaaactgacctggaaagattattgatacagatgtgaggaggtgtggggcaagattccaggcaaaataaatgaatgttagacgttgctgactgggcgcagtggctcacacctgtaatcccagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgcttaagcctcaggaggccaaggctatagtgagctgtgatctcaacactgcactccagcctgggtgacagagcaagaccctgtctcaaaaaaaaaaaaaaaaaaaaaaaaagaatgttaagccttaccgtgctcagagtcagtcaggactgcttgaacaggccttcccagctgcccacagcagggaagcttggcagctgaggtcttcggtggatttcaaagccctgctaaagatggcatcctctgtgatgttttccgcaactgctcctccaaatggataggcactgtcctggctgtcaccttattatggtctcttgatttcctcagtagacagtgcctccagggcagggcagtgtcttaggtctctcatacctggcactcaagtgttcgcctgatttcctggcatccccgagcagtcacttcacctgatgaagacactgcacccagagaaactggatgcctagcaagttaacattaggttctggagctacaggatataccaagttaaggtgtggtgaggggagtcctgctgctgtaggtggtgatgagggaggaggtaggtggggagcaacttctttttctgctcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgaggtacgtgttttagggatgtgggagctggattcctattggccttgagaagcaatccttggatcttcagacagggaaggacactcaggctggactagagtccagttttctcccaataccggaagttctccagcttctgcttgaatgtccttaacatggctgaactttgacagacaattgagaccagatgtgagggtgagaagaaaaagttcaaagtaaaagcaacaaatgttaaacattacatttcctaaagcccagctcaattaattgaggactgtgcttgaaaagcctttcccttcaatatttgcagaggcttgttccacctctgggtagccccctaatcacagaaagcccttaattatgttaggctccacctgtctcctggtaacctcccactggtcctagccctgccctctgggggctcagagccttgcatactcaccctggtaacccactcccttcaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaagtaagtttgactccaggggctggggggccaaggcagctgagatcctataagggaggaagtgttaggagcagctgtctccatgtcattcatattctcccaccacataccagtcccagggaggggtgaggaggctctgaggcagtgctgggggtgctctgccctcgggtgtttaggacagtgggatggacaaacgagtagaggattgaagataatgcaagactgactgaaattcctttaaatgcgggtataaaaaaggtcatgtggaaacacaacaggttaactctggatggaggggagctggggaatcagaaatggaagaatcgaagggctaccagggagggtgaaaagtaccctttgccctgactccaattctcgattcctactttcagttcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtgcttccgcctgatttttggggctgcgggggcgggaccggggtgtgaccgcctcggggtgggccgcgagcaaggcaggcgactccactgggcgccatcttcggggaacgactcagcgcaggattgtaaatacaccgctggggtggggcggggaggacggtggcctgcaggacgcaaaaagcggaagccgaagcatgaggcctgcgaccgttaggcgggcgcgcgctcagggattagccccgccccgtccgtgcccccggcgcgcgcgctcccccattctcccgctcggcaacgacggcggccttgtgcgcgtgcgcgcgaaataacggccgctggcggagggagggggagtggaatcgttggcggggggaagaggagagaagccgccctgtctcccgcgcgcccaccacctgcgccatcgtcagccaatcagcagccgtctcaggggtctcgcgctcggggcgactcgggctgctgggtggctcccccgtccctcctcccgccagagtccctctcgcgcctgcccctcccgctggccacgcgcgcgctcgcgctagcgctcgcgcccgctccagcctcttgtgtgtcctcgcgccccccgcccgccctccccgcgcgtagtgtgctccgcttcccccaccctccacctcccccctcctgcccgccccgcgcgcctcctcccgggttccccctcccccaccgccgccgcctcctcctcccgccccagggtgagcgcgagccacctccctccctccctccgccatggatcccagcaactggagcagcttcatcttccaggtaacaactccctccccccgcccccacccccctgcccacaccccctcctgcccgccctccctcccgtcccaccccccctccgcgcgcccggtgcgcgcgcagctgtccccctccctccctcgcgccctcccccgccctccccgaggcgccggctgggcgcgcgcgcggcgggggccgaggctgctccctcgctccccccaccccgccccgccaggctccaaccgccgccgccgccgccgccgccgcccgggcccccgcccccggccccggccccgcggggcctcccgcccccacccagggggcgtcgccgccgccgtcgccgcggcgctccgcggcccgcaaggcgccctcttttcctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggtgagtagggccggccgcggcggcccgggctggggggggacgcccgcccgcacccgcggcccactcggcgccttgtctccgcaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccaggggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgaggtaggaagcccgcctcctcctgtcttggttttcatgattttgatcctcatggtagctgtctgagtcagtctctcagaccccctttttctctctcttctttttgcctttttgctccattttctcatcccttcttcaaggcctcatcatgtcactcccatttcctacagatcaaagatccccaaggctctgattcctttaatctcttgctcccccctccccagcccaccaagctttaactctcctgtgacaccccccacgcccctcccccctcctcagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaagcgggagtggaacttggctgctctggggaaggagtagtcaagaaagccagttccaggggtcacaaggcaaggtttccgctgcgcagccacaaggtcttgtctccagctcctggggcaggtggagtacacgggccgggctttaccagcacgcaccctgcacgggtagcagagaaagctgccttcagtcagactcaccggttaactgggttgagaccgcggggcactggagggaaggggacacagccgtctctgctgagggtcaaccctgcaagtggctaggagtcagtgtctcgtcatcctgggagaggtctcccggccatggagaatgagttctgtaggtaccaaggctgagaagcgggcaccacacaagccaggccccaggctcagggaggggctgtgtctaccagccccaacagagcagttggccccaggctaccaaggataccgtgggaggaggacagggccatctgaggagggcatcccccgcctaggagatcagccccgtctctggggtctccgcctggctgacccccgccccatcccaatccaccccccaataggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccgccccccctgtcccgggagacgccccccagccacagcccacctgctgagggggacccccgcacccaccaggcaaggcgtggggcatggctggggggcgggatggggggtgtgggggacaacggggctcaaagggcccaataggggatctcaggaaggcgagggatgcccatgtaccactcaggctagggagacttctgggcacagggaggatccttgagaactgctctgtctgggtgaggatgcaggctgaggcctctggggtccagataggaagtgagcaacggctgtgtcccaggggaagcaggctgggaaggtgtggggtgagggcaaggctcttgccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattgaatgaattgccctcactaagaactgccgccaaccccaagggtttcttctcggcctggtgtccgtcaatccagccttgctctgccctgtgaggctgtgaggttctggctccgccctccccaggggcagccttactggcggcagcacagatacagggcggggccaaggctgtggctgtggagagcaagttccaggtctctggggaattcccaactcggacaggcccagaatagcccctggaggtttgaagaggccccgtcagaaacccaaacagagctgccagacgggaatgccgccctcccccgtccacactcatggccgctgctcagcccccagccgcatccctccccacgcgcgtcacggccctgaggccatggtgggtggatgcggctgcggaaaggctggggagtccgagccctaggactgggagcagcgaggtagagaatgaaagctgcacctgtccctcatcctgggcatgggccactctgtgtttacacgggctcctctgcccagctcctcctgccccttggaattccctttcctgtccccgctccgtcctttccagggccccttttttgagccttccagcgccagtttctgccgctcctttctgcaggctccattctctccaaaccccaccctgctcctcctctgcagcctccccgcgtcttgccccatcttccttgccctcctgctcgtagagacgcctccacccggtcctgcctgtctcactggtcccgtctcctcgcagaaccctctccgtttcccccaaatccccgtctcttccaggaatcccggtgaccgttggcgggaggggccggggacttaagaaggaggcgtctctcctggaggcgcgcgtgagaaggggcagggagggggcgcgagtggtccccgggccggttgcctgggtaacgcgtggctcccttgggctggcgggaggggccggaggctcgcgaggggcgggggcggcgacggcggcggagcgtaggggaggggaccggagaggaggggatgagcacacgggagaggagaagagggagacccgccgcctccctccctccctagctgacttgctccctcccgggctgcggctgctgcaaaagccagcagcggcagcgggagctgtccggaggccggcgtcgaggtgagacccgggcagactgaggctgcgggtaggagtggaccgaccgacggctgacgccgggcggactgcacgggaatgcgggtgtctggagggctggtggtggtgctgggcgggctgaaccatcgggaggaggcgccagcccaccgaaggcgagggaagccccgggagaggggctgacaggggatcgaaggagataaccaggtcccccagaaaggggcgggagcgtcctcgccctaaacgcgcagcaagaaaacccgcaccgcctgggagcccagggaggaggggaggatgcagagggagtggaatgcgaatgtcgggtcctctgcccagtcggcctgtcggagtgctatttgcacagctcgttgattttggggtgctgggatctgagagtctggatcttgttggatggacccagggagagaccctggagaaggtcctgtttacaaaagggttaatcttccccagggctctccaagcagaagactttgagtagagcactcctcccgcagggatgtcccaccctaaggcaaaggaaaccccaacttttcttcctctccctagaggcagtgcaaggctggccctgagacaggaatgtggcccaattgggcctgcagtgctgagcgccctcttccctcctcaccccaagcctatctcctcctcttccagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccaggctggagtctgcagccccacctgaaccagccccagagcctgctccccaaccagacccccggccagattcccagcctacccccaagccagcccttcaaccagagctccctacccaggaggaccccacccctgagattctgtctgagagtgtaggggaaaagcaagagaatggggcagtggtgcccctgcaggctggtgatggggaagagggcccagcccctgagcctcactcaccaccctcaaaaaaatcccccccagccaatggggcccccccccgagtgctgcagcagctggttgaggaggatcgaatgagaagggcacacagtgggcatccaggatctccccgaggtagcctgagccgccaccccagctcccagttggcaggtcctggggtggaggggggtgaaggcacccagaaacctcgggactacatcatccttgccatcctgtcctgcttctgccccatgtggcctgtcaacatcgtggccttcgcttatgctgtcatggtgagccccatgggaccctagcccaggcctgctgtggctcccagcttcccgccagcgctgcaatagagcctctggagtaatcatgccttccttcccctctcctctctgcatggatcccacctccccaattccagggcctttgtttgcctctccctaggacctaaccctctgagccaccactgccctgcccctttgggtgggagggatatggaaacacgtgtcacacagcctcgctgacctgtgccctcctccccctgccccttcactcctccttcctcccttacccgccatctatggggctggcctctctctcttctggatgacttttccacctgatcccttctgggctggcttctcctgaccccggctatgtgcctccacccctcgccctaaccccagtcccggaacagcctgcagcagggggacgtggacggggcccagcgtctgggccgggtagccaagctcttaagcatcgtggcgctggtggggggagtcctcatcatcatcgcctcctgcgtcatcaacttaggcggtgagtgggggcttgggacaggcaggggaggaatggaagggttggcaagggcagctttactaacccctgcccctgctctctcctgtctgtcctccttacctctcctttgtctctccttgtctccccctccccccgtctgtccttccctctcctctcccacagtgtataagtgaggggctctgccccgcatcccaagacttttcttcctgttgggagctgccttgggcccatccctcccctggggggagcccaactgatggccctggcccccacccctaaggaccaagggagcctgagcggccttgtttacagcttctgtcctgctcctgcatcttgccaggctcctctgccaactgtaggcctgcctcatccctgcactggttccaacctccctgcactaatgcctgcatcccctccggcctcttggccccctatccctgcacttctggaaacctccctgcactctggaaacctccctgaacacctccccaactctgcgctctcagcctccctgcatctctcctggcctccctgcacttcttccagccccccaaattctctggacctccaccctggccgcctcctcccaactttcattgtcttggcatctctcaaccctcagtcctctcttccttcccttctttatcatctcccctttcctctccacgtcccgcccccttcctcttcctgcctcctcatctcccttaagcatcctcttctccaacctcccgtcaccgtttactctgcaaaattgacagcacttagacgaggcttgggggcagggagcagtgttgggagagggctccccaaccccaggctcggactgttctctgctgggaccacccagggtcggacacccaagggtgcctggcaggtcgcagagttggcaagccgggcctcgtatggggactcgggtgagggtggcgagtactggttccgaacgcacgcaggggagaagggagggacgcggcgctgacccttccaggtcagctggagttgacccgcccacctgggcttttcaaccccagtccgcgagtttctttcttgaaggtgtgggggctagattcattcacgtgcttcgtaatgaaataatccaaaaaataggaccaaagcgcccactggcaggagcgagggcggggcgccgcgctctataattattttctaagatgatgggggaggtttgttgcacgcgacagcccgctgaggaggcggggaccgagctacaacgcggttcggatttggcgggggtttttttccttaaaaaaaaaaaaaaaaaaaaaaaaaaagtctgggggaagaaaaaaactaaaattcttaaaaaaaaaaaaaaaaggctattatcaaactgatttctccctttttgtatgccggatgctgcatgagtctgaaacaccaataaacggagactgcatgagactcgcctccaatctcggttggttcctgcgttcgtcccgccggcccggcggtgctgcctttctggcagaaccttactgggtggtatacgcatgcgacttcccggtggccatctttactgtgggctgaagcctgtgcgcttactcgcgcatgtgcaagccttccctcgctttcctcttccaagtagccttgcctagagcggagcctcccgcgccatttctgtgcgcctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgccggcctcccacgccggaggcccagagcgaagaggagagatccgatgaggagccggaggccaaagaagaggaagaggaaaagtaaaggcacacccttacaccttgtcccggggctgctcccctgatggcgggaggaaatagggaggggaaaatgtgggacgctggaacctttgaaagtggagggagggaagccagcgggggaggaggaacgggcaggggagaagcacacgtgtgggtgggagggaggaccgccctcacccttaactatgttcacctgtcccagaccacacatgcccacggaatttgattttgatgatgagccagtgacaccaaaggactccctgattgaccggagacgcaccccaggtacaaacgaagaggaaacagttgggggaggtgaagggcctcggctcagttacccaagatcggctcccctagaggcctttgcttgctgcctcagctcccacacaacttacagctgcaggagagagtattcacccagtagcaccatctttatgacttagattactaccttgtcttccttttttttttttttttttttttgagatggagtcttgcccttgtcccccaggctggagtgcaatggcacgatctcaactcactgcaacctccgcctcctgggttcaagcaattctcctgcctcagcctcccaagtagctgggattacagacgcatgccaccactctgggccaatttttgtatttttagtagagacaggctttcaccatgttggccaggctggtcttgaattcctgaccttgtgatccgcccacctcagcctcccaaagtgctaggattgcaggcatgagccaatgcgcctggccccttgtcttcctttaagagacaattataatacaaaaaattagccgggcatagtggcgggcacctgtagtcccagctactcaggaggctgaggcaggagaatcgcttgagcctgggaggtggaggttgcagtgacctgagatcacaccactgcactccagcctgggcgagagagtgagactccgtctcaaaaaacacaattacagataattctttttttaaaaaaacaactagtcattgattctggaaaattacagataattctatcatgtttcccattcccagaagtccaagtcctggcctttcaatattatctagatctgcatccctctactaccatgtacattctttaatcacaccgctggccccatttcccaccccacatgccttcctagaatttaccctcagagtcatgcctttccttttttcttttttttgaggggtggagagacagagtcttgctgtgttgcccagactggttggtctcgaactcttgagctcaagtgatccatccgcctcggttctcaaagtgctgagattacaggcatgagtcactgcacccagcctagagccattcttgatttctctctcttttacctgaacattcacaccagcagcaagtcttggtagctataagatgtacatttccaagtacctctgctagtctccactttcaataccacatccccatccaagccactgtctttcttgcctggatagttgtagtagctcctaactgggctctctgcttccagcttctgcaattcagatgaaccttttaaaacataaatcatatcactttttttttctttgagacgaagtctttctcttgctcaggctggagtgcagtggcatgatcttggctcactgcaatctccacctcctgggttgaagcgattctcctacctcagtctcctgagtagctgggattacaaggacacgtcaccacgcctagctaatttttgtattttctagtagagagggggtttcgccatgttggcgaggctggtcttgaactcctgacctaaagcttcccaaagtgcctgcctcagcttcccaaagtgctggaattacaggcgtgagctgctgcactcagccataaatcgtgtcacttttccacttaaaattttccaagggattccatcttgccagggaagagcatgtcaaaggagaatccaagcgcttttcccgccacctccagttctctgcactcttttttttgtttttgtttttggcgagtaggggagacggagtgtagctgtgtcaccgaggctggagtgcagtagtgcgatcttggctcattgcaacctccacctcccgggttcaagcgattcttctgcctcagcctcccaagtagctgggattacaggcgcccaccaccacgcccagctaattttttgtgttggccaggctggtctcaaactcctgacctcgtgagttgcccacctcagcctcccaaagtgctggcattacaagcgtgaaccaccatgcccggcctgcactcttctttgaacagaactctgttcttgtcctggggcctctacccttgccattcccctgcccagtatgttcctccctgttcttcacattacctgtgccttcctgtcaatcaagatctttgcttctcaccctctctgaggtccaaccctgaacctcaggtcctccaagacagaggcctggggacctgcatgtttaaccagctccccaagtgatgagtgaggtccaggcaggtatggtgtacaccacctccatcccttccatgtatcttaccttcctcttctccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagctgcagcagaagcagcccggaggataaaatgagaaccagctgcacacgggccctttaactcccaagccccacccctgggcttggcctgccttgccctgccgggaagtgatccccaaggcagggtgagagttccccatctgaggcgtttgttgcagctacctgcacttctagatgtgagtacattgtactagccccccaaaccccaaatcaggggcagatctttgtatcccttgaggctctctttagtcctgtcttgctttgaagggccttgcttctgctggggcagggaaaacatgtctgaatcagagtggggaaggaggatgggtggtggctttgcttttggaggtttcactttccaatagttgggagtcttctgggttttgaagtaaaggcagattaacaccaacaccggtcccccacccccctgcaactctcaggcctctctctgacttcagggtcccacctgggaaatcaggtggggaaccttacagggtcattcagaccccatcttagccctagatcggtgcttgctctactcacctgcactgtcctggggacctgggctctggcctgtcaccttgagctccaagaatgtgacctgtacccattcaggccccttaactctgacagatgagggtttcttactcctccatgcagggctgggccagctgttggtctcagtcgatcattcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagcacttgggggtggaggtgatagcgaggctgatggcccctgtgttctcagctctctgcctgggtagcccctgggtgatgggggagaggccagctgtcacgtggggtatcaggtggctctgccagaaactcccttggcacacagagcactgggtcggccctcgggtgtggctgtttgggcaggacagccctctgtatgtagccttgagcaggtaggggggccaccttgagtgggtggcccagagacagcctcagggctccaaggtaacggggtgctcaggttatcttgggtgctgccctcccaggttctgggggagcagaggctgggcgctggcccaacttacaggaaacactcacctttgaactgccattagcaccatctgggcagtacacagccccacccaggtcctctagttcttgttctcggcttagaatctttgtgtttctgcctgagaagccactgcctcctagtttgtggtctctacagttatagccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttacttaggggcgtttgcctagaacacagggtccagaggctctctcccggaaacttagacccagtgagtcagaagtgaggcctgcaaaaagcagcaggagtggggttaagaattccagcctagggctggatgcggtggctcaggcctgtaatcccagtactttgggaggcccgaatgggaggatggcttgaggccaggagttccagaccagcctgagcaacatagcgagaccctgtctctgtttgtgtgtgtgtggttggggttttgttttttttttttttttaaagaattatagctcagtcctatgattaggcaagttgagaaaatattgatgaagatcaggggtgctgaagcctggttcctggggtcgcttctgatctaggcggttcttgcctctggtgactggtgttaattggcaggagtgggaggagggaggacaagtggaagtctaggctggctgagctgttctgtctcgaaaagttcctaaaactgtgctgctttaaaaaaaaaaaaagtaatttatgagacacattctcaatttccattaatcatctcctaaagggggtaaaccaggaagccgctgggtgaaaacaggctgttggcaattcctgagtcatgtgacccattctctaaagactagaatatttaacttaaatcagtgagaaactctgtgaagttgtgtccttgtttataccaaacttcatgtgccttttcctgaacctgaagctgtgggaaggtctgggggcagggccgcatcaccgaccttacgtccaacctcaggactgcctggagcaagagccctggggttggggacaaaggaggctgcctggacctgggtaagggaaggggctggaggagaatgagtgcaattccctgcccttcacagcctgcaatcggagctgtgtttttgtttttgagacagagtctcgctctgtcccccaggccagagtacaatggcgcaatctcgactcactgcaacctctgcatccctggttcaagcaattctcctgcctcagcctcccgagtagctgagactacagttgcctgccaccatgtacggctaatttttgtatttttagtagagacgaagtttcaccatgttggccaggctggtctcgaactcctgagctcaggcaatccgcctgccttggcctcccaaagtgctgggattacagccactgcgcccggcctgaaactgatctttatcctcctcccagttcctactgtgcaccagagaccctccagtctctaatacctttgacttgaagagcagtcatttttttttccttttcttttcttttcttttttttttttttttttttgagatggcctcactcttgcccaggctagagcgcactcgtgtgctccatttacggctcactgcagccttgacctcccaggcacaggcgatcctcccacctcagcctccaaagtagcagggaccacaggtgtgcaccaccacacctagctaatattttttatggtttttatagagacagggtctccctatgttgcccaggctggtcttgaactcctggcctcaagtgatcctcccatcttggtctcccaaagtgctgggattacaggtgggagccaccaagcctagtcaacagtcacttttattctcacttcactggagaggaaggctcagaggctagtaagtggcccaggagcatgctggcagtgataaaacctgctggagtgacattttcccactggctctcaatcctggatatatattaagagtcagaggccaggcgcggtggctcacgcctgtaatcccagcactttgggaggccaaggcaggcggatcacgaggttaggagatcaagaccatcctggctaacacagtgaaaccccatctctactaaaaatacaaaaaaaattagctaggcgtggtggtgggtgcctgtaatcccagctgaggcaggagaatggcatgaacccgggaggcggagctgcagtgatccgagatcgtgccactgcactccagcctgggtgacagagcgagactcgtctcagaaaaaaaaaaaaaaaatgagggagaactttttacaatagcaacgggtgaacctcacccagaccaattaaatagaatcaccggagatgggtggctttaaaaaaaggtctccagaaggcctggcgcggcagatcacacctgttatcctagccctttgggaggccgaggtgggtggatcacttccagcctgaccaacatggcgaaaccctgtccactaaaaacaaaattatctgggtgtggtggcggacatctgtaatcccagctacttgggaggctgaagcaggagaattgcttgaactcgggaggcagaggttgcagtgagccgagatggctacactccagtctgggcaacaagcacgaaactccatctcaaaaaaaaaaaaaaaaaaaaaaaaaaaaaacagatttccagatgaccagtgtgcagcccgagccgagagtctgctttagaccagagctgctcagactgtaatgtgcatgcaagtcattgagggtcgagttaaaatgccagtagattcagtggctctggggtggggccccaggctgtgttgctatcaagcctccaggtggtaccactctactcactgcagaccccgtaggcagtgtggtcacttggtcaattgccatttaagactcactaggggccaggtgtggtggttcacgcctgtaatcctagcactttgggaggctgaggcaggcagattgcctgagctcaggagtttgagaccaccctggggtgaaaccccatctctactaaaatacaaaaaattagccaggcttggtggcatgtgcctgtaattccagctactcgggaggctgaggcacgagaattgcttgaacctgggaggtaggtggacgttgcagtgagccgagattgtgccacttcactccagcctgggctacagtctccaaaaaaaacaaaaaagagattcagtatatcagctactcacagttgaccctgaagatctctgggaagtagtgactcatgactcgtttatttattaagttttgctgtagcagaagtttacttttgagccaagagtctgatccggtctccctcttttttttttttttctttctttaaagagatggggccttgctatgttgcccaagctggtcttgaactcctggcctcaatccatcctcccaccttcggcctcccaaagtgttgggattacaggtgtgagccacctctctcaggcaagagcccctcttttaactagacaatgaacctggtttctgctttggacaggctatttagttcctgcttatttaccctcatggtgggagagaccctggtgggatttggggtgaaagctggctgtggttcttgcaggagcctcatgacacctgagggaggtgtgatcaggcaagactgggcctctacactgagagccgactagggcaggtctcagaagcagagactgaaggaagttgggtggatgagtggatctggggagcaggggccaagcctgagggctgggcagagccttccaaaggtcaacacaatccttgctattgtcttttgagggccctgatctattttaagtaaaatgctctaactgcgcatgtcatctggaaggaaaccacaaaaaactcaatctgagacttgtcaccaatgtgctgcctgagtcaaagggtttccctggctcacctccatagatggcgagggtagaaggcaagacctgtcctgggtggtctaggcagaaggcccaggtttagggcatggcaggtgggtggtcagggaggtgaggtggggtcctggtgctgatgcaggggcagttgccgagggcttggcctcagaacaaggcaggagtccagccatgaggatgactcttgctgagtcactgagctgggcgaggcattcagaccccctgactgggcccagctggggcggcagatggtggagaggcctcagctgtggggggtgttggggagattatccactgatgaaccaaatggaggctgttcccagagcctgcttccaaccttgcacggccttctagagttcaaatctttcctgggggggcctcagagccctgtccatacctccgctcacagccccagcccttcctcttctcccatctggtttcctggccaggtttcggccctgcggagaaccctccaagggagcagtggaaaaagcttcacttggcagtaaagcccctacttgctgttccatccctgcagctggggtgaaataagccactgaccagtaaacaactgaggcttaaaccagcatgccagctcaggtggggagcccccagcactggttatattccctagattcctcactggataggaaagttgggcctcaggcactcttccctcctctgcagtcaaacagtgcagatgaagagccaggctctgttcccagtgctttatgtgctaacttggttgataatgttatccattctcattttgtagatgaggaaacaggcacagggtggtcaagggacttgttcaaatcactgatcccataagggtgagagccaagatccaggcatcctggctgggtgcggtggctccacctgtagtcccagtgctttgggaagctaaggctggatgactacttaagaccaggattttgagaccagcctggacaacaaagaccttatgcctacaaaaaattaaaaattagctaggtgtggcagtacgtatctacagtcccagctactcgggaggctgagatgggaggatcccttgagctgaggagttcaaggctacagtgagctgtgatcactgcactccagcctgggcaacaaagtaagaccttatctcaaaaaaaaaaaaaaaaaaaggccgggcgtggtggctcacgcctgtaatcctagcactttgggaggccgaggcgggtggatcacaaggtcaagagatcaagaccatcctggtcaacatggtgaaaccccgtctctactaaaaaaaaaatacaaaaagttagctgggcatggtggcaggcgcttgtagtcccagctacttgggaggctgaggcaggagaatcatttgaactggggaggcggaggttgcggtgagccgagattgcgccactgcactccagcctggcgacagagtgagagtccatctcaaaaaaaaaaaaaaaaaaatccagatctaggcattcccagccctctggactctaggaagtcgtctttccagaacagagccccgtattgtggagcaactggggggtggaatcaaaggtgagcaggacagggctataggaagaaaagacaaggtccccataagagtggcgagaggaacagagccaggacatcggaaagcaagcccctgtgttcccaaaccgcagaagagggagctctgatgttagacaagccaccctcctacaagcgaagggaaagtaactttgagcaaaaatgagcaacagaaaatgagatcaaggtcagatctcatacaaagttgcaagatgaaagaatgagcagcagaataacctccctgtgatgtggaaagtgtgccaggaaaacagacccaaactgtaacctctttcagaatgaggcaaggcagtgaggaaactatgtgaaaacacgaaagcagccgatcagagttgtaagcccgggcagtctgggttggaatgggtgccccgagccacgggaccatgatgcctctctagaaagacaggaccaggcattccaccagggttctagtcccaacagcaccactaacttgcttgtggccctaaaggattcattgtccctctctgggtctcaactatttagagctctactgtccagtatgggatcaaccagccatatttggcaatttaaattaaaattagctgggtacggtagcgtacccctgtaatctcagcactttaggaggctgaagcgggaggattgcttgagcccaggagttcgagaccagcctaggcaacatagcaggaccttgtctctgcaaaaaaaatgaaaaaattagctaggcgtggtggcacatgcctgtaatcccagctactcgggaggctgaggtgggaggatcacttgagcctggaggttgaggctgcagtgagtcatgattgtgccactgcattcctgcctgggcaacagaacaagaccttgtctcaaaaaataatttaaaaatttagttcctcagatgcattagccacattttattttatttttttccaagacagagtcttgctctgtcgcccagggctgtagtgcaatggcgagatcttggctcactgcaacctctgcctcccaggttcaggcaattctcctgcctcagcctcccaaatagctgggattacaggcacgtgccaccatgcccagctaatttttgtatttttagtagagacagggtttctgcatgttggccaggctggtctcaaactcctgaccttgtgatctgccgacctcagcctcccaaagtgctgagattacaggtgtgagccagcatgaccggccattagccacattttaagtgttcaggagccacatgtggatgtggctagtccaaagacagcacagatttagaatattctcatcattgtagaaagctctattggacgctgctgagtaaaagggtttttttggtttggttttgagattggagtctcgctctgttgcccaggctggagtgcaatggcacgatctctgctcactgcaacctctgcctcccaggttcgagcaatcctcctgtctcagcccccctagtagctgggattataggtacccgccaccacaactggctaatttttgtatttttagtagagacggggtttcgccatgttggccaggctggtctcgaactcctgacctcaggtgatccacctgccttggcctcccaaagtgctgggattacaggcttgagccaccacgcccggccaagttaaagggtttttaaacaagagctgggcagtgcaatggcatagctgtaaggcagcagggggtggtggggactgtggtaggtgggaaagcttgtgttccatctaaatggggcagctgctgcttgactgtaggctgtattgctggtcttctaattcttcaagtgaatcaggaattgggattttgtgaagactcacaatttctaaacaaaaagttgaagttttacagatcgtggggctcaagtataactcctcttgggctgtatccagccttgattctgtaatctgtggctcctgcctgtttttcctcggccaggccactcccttcttcccctcacttatatttttcacctggggttggaggctgggtagatggtggaattgatgaggaaccacttttttttttttttttttgagatggagtctcactctgcctctcataatgctgggattacaggcatgagccactgcacctgtcctggccagacatttttgaggccaccaccagacaaaagaggctcctcatcggccaggtgtgatggctcgcctataatcccagcactttgggaggcagaggcaagaggattgcttgaggccaggaattcgagaccagcctaggcaacataatgagacctcatctctccaaaaaaaaaaattagctagacatggtggcatgtacctgtagtctcagctacccaggaggctgaggcatggcttttgtgagctatgattgcaccactgcactccagcctgggtgacagagtaagactccgtctcaaaaaaaaaaaaaaaaaaaaaaaagtctgacctgagtctcttaaggatgaggctctggagcacctagtaaacttggtcccatttgtgtgactcaaagggacatgtccaaagtccaaagtgctgggggcaggggtggggcttaggtagggcatgtgacattcctgaacaggccaagcactgggtgaaactactcaggattcagaagcaggtgggatgggtgggtggaacatgataatcatcccccttctccttcctttccaccctacccttgctcacaactgcaggagctgaggatgggagagaactggggacgagggggccagagtgatttgcagtgttagtaatgcagctggttctatggaaggctcagttccatctgggatccctttatgagcagtggactaggtcttcacattcagcccaggattactaaagcataggaaagaggcagggaacatagacacagctcatgtaaacattccttttgtttatggccgaatcctagccactggactacctgaggcatacagatattctttggctatgggctgacatttgaatacagctggggcctcaggattctctgaaataaagggctgcctccctctggaggagccaggcagctcctcagagcagctgcccattgcgtgctggacaaggccatgtcaccacctccatggctccccagtttcccagcttgctgtatctctccaccgtaagagactgggagcaccttgatctgaagctctttgcagtgccggtggcagtgtagggggaagtagttgatgggagtgagggaaaggaattggcaaggaaccctgggcctctgtggctcactgcatcaagcagttcttggcaaaggtaaggtcaggatgggctgtgtcgtcttgggtggggtgaagacagggagcagtgggcatgcagatgcggacagggaagggtgcagtggcctggctggaggaggtagggccgtatcccacccagagtctgtcaccagattcatgcctgccccaccccaggctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggtgggtgtgggggctgggctgtgggggatccttggggatgtgggggcctgtttggctggcatgatggtccttatcctcctccctcttcccaagcaggagtggccctcgcttgggcgatagagaggtttctctctcatttggtgtcctctttggtagtggagacctggtcccaggtcctcacacctcttctcatcttcctgcagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggtacctggtttcctcactccctatgccccaccctacctgtcctccacctgccttgggctctatactgctgccttcttcttctttttttcttttcttttttgaggcagagtttcactcttgtcgcccaggctggagtgcagtggcataatctcggctcactggaagctccacctgggttcaagtgattttcctgcctcagcttcctcagtagctgggattacaggcacccgccaccacgcccggctaatttttgtatttttagtagagacagggtttcaccatgttggccagtctgatctcaaactcccgaccccaggtgatccacctgcctcggcctcccaaagtgctgggattacaggcatgagccactgttcccggcctgtaccgagttctaaagggaaaacaaaccagggcagtgggaggggtggggagagacacttgctggctctcaccaagggtggaattgactcactgtacctccactcacctccagccacccccatcctccacacatgccccaaacacacctgcctcttttctgagaactgttggcccatctcaccttcccaggctccagagcctaccagaagtgcccagccagtctggcattaaatgacatgtgccaaggttaagcagttcattcacccggtgccagacactggtgggcagtgccaaagcagcagtgacaagcccaggccccaggctgtgcctgttctaggagaagccatcacaggcctgaacctacagccaggctcttgtccccgttggcctcaggcctgggcctgagcaggtgggtgtcccaccttcattcctttacctgttcttccacctttaccttctggccatttaatggttttgggttttttgtttgtttgtttgtttgtttttaatagagacggggtttcaccgtgttagccaggatggtcttgatctcctgacctcatgatccgcccgcctcggcctcccaaagtgctgggattacaggcatgagccaccgtgtccagccccatttaatggttttcttactgactttactaaccagtgctgcttgatcctgaaagcataatagcagaacatggggaacttttagagacattcatgtccacttaggtgcagacagtttgggggaagaagtgtgtgtgtagagagaaaatgaagaatgattaagacaataacccttaaggaatccaagtgaaaagtatatagggattcttgtacctttttttttttttttttttttttgagatggagtctcactctgttgcccaggctggagtacagtggcataatctcggctaactggaagctctgcctcccaggttcacgcaattctcctgcctcagcctcccgagtagctgggactacaggcgcccaccaccacacccggctaactttttgtgtttttagtagagatggggtttcaccgtgttagccagggtggtctcgatctcctgacgtcatgatccacctgccttggcctcccaaagtgctgggattacaggcgtgagccaccgcgcctggcctttttttttttttttttttctggatctccccctgttgcctagacgagagtgcagtggggtgatcatagctcactgcagcctcaacctcctgggctcaaacgatccttccacctcattctcccaaaatgctgggattgcaggtgtgagccaccaagccctgcctaagctttcattttaaatatgttcagccgggcacagtggctcacgcctgtaatcccagcactttgggaggccaaggtaggcagatcacttgaggtcaggagtttgagaccaggctggccaacatggcgaaaacccatctctactaaacatacaacaattagccaggcgtggtggcatgcgcctgtaatcccagctacttgggaggctgaggcatgagaattacttgaacctgggaggcggagattgcagtgagctgagattgcgccactgcgctccagcctgggtgacagagcaagactctgtctcaaaaaaaaaaaaaaaaattagctgggggtggtgacacacctgtaatcccagccactcaggaggctgagacagaaggatcacatgagcctgggagattgagactgttgtgagccatggttgtaccactgcagtccagcctggatgacataggaagaccccatctccaaaaataaaaaaaagccagctcttcctttgagccccagtttcagttcaaagggccttctctaacttctccttcatctgaactcctgagacagggtcttgctctgctgcccaggctgaagtgcagtggtgcagtcatagctcactgaagccttaacctcctgggctcaagtgatcctcccacctcagcctcccgagtagctgggactacaggtgtgcgccgccaccatgcctggctacactttttttttttttttttttttttagagatgggatcttgctatgttgcccaggctggttcttgaatgtctgaggtcaagcaatcctcctacctcagtctcccaaagttctgggatgacaggtgtgagccactgtgcccggcctccaccccagtcttatttcaggacatacagagatggatgttgtggacccgcctccagagcatcaggcttggccctggggtcacagcactgatggttctgtgtctccaccttcttccccactaggacatcacacccctgcaggtggttctgcccaacactgccctccatctaaaggcgctgcttgattttgaggataaagatggagacaaggtggtggcaggagatgagtggcttttcgagggacctggtaagttctgtctccatagggctccctgccttcctgtcatagccctgataccttctgaccatcaccttccctccccaggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaaggttgaggaaagcctcctgtagccccagagaggcgctttcctggtatcttttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagatgttcaaatacaattgacaaatgtaggccaataggtacagtggctcacacctgtcatcccagcactttgccaaggtgggtgaatcgtctgagcccaggagcttaagaccagcctgagcaacacagtgagaccccatctctacagagaatttaaaaattagcctggccttggacacacacctgtggtcccagctactcagaaggctgaagggggagaatttcttgagcccaggatgtggaggctgcagtgagctgtgactgcaccactgcactccatcctgggccacagaggtactaccccgaggtgctaccattcccactttttttttttttttgagacggagtcttgctttcttgctgttgcccaggttggagtgcagtggcgcgatctcggctcactgcaagctccgcctcctgggttcacaccattctcctgcctcagcctcctgagtagctgggactacaggcgcccaccaccatgcccagctaattttttttttttttgtattttttttttttttttttttagtagagacagggtttcaccatgttagccagggtggtcttgatctcctgacctcgtgatccaccaggttcggcctcccaaagtgctgggattacaggcgtgaaccaccgcacccggccattcccactttctatatatcaaaactgggatgcagaatgcaggttgcttgccctggggtgtggccaggcagggcgaggctgggacctgcatccaggcactctggcttctccagtaaaccaaaggacatccacaactctaacagaggcagttctgctgcctgttttagcagaaggacaaaagttggtctttggagcttagagaaggcagaacaggctgttggcatagcagcaacttgggcatcttaggaggccaaggtgggcggatcacttgaggccaggagttccagactagcttgggcaacatggtgaaacaccatctctacaaaaaatacaaatattagccgggcgtggtggcacgtgcctgtaatcccagctactcaggaggctgaggcatgagaatcacttgaatccaggaggctgaggttgcagtgagctgagatcacagcctgggcaacagagggagactccgtctcaaaaaaaaaaaaaaaaaaaaaaaaacttttaaaattcaactggggtgggggtttggcctcaaaagaatgaataagaggaccgcagtcaggaacttgagcctggggtcagtgctatctttttgcctatgaaatctgtcaatcccctgtgtctaagctgtgggggaggggtaggtggggagcaggctggggggcccttgtcccttaccctccactcttggcccaggggaagaatggctggtcaccacagtaggggcgtacctcccagcggtgtttgaggaggttctggatttggtggacgccgtcatccttacggaaaaggttggtgctctgggggctgtggtttaagggacctggggctagggaaccctccgagtggcagagaatggtggtagaatggcatgagagtaaaagagaagcaataattttagggtcacttaaaaaaattcagagatcagattgcctgagtattctggatcatctgaagggttaaatagtctttctggggctgggcgcaatgactcacatctgtaatctcagcaatttggaaggctgaggcaggaggatcacttgaggccaggagtctgagaccagcctgggcaacacagtgagaactcatcgctacaaaaaatttaaaaattagctgggtgtagtggagcatgcctgtaattccagttactccagaggcgctgaggcaggagaatcgcttgaaccccagaggcagaggttacagtgagccatgatcatgccactgtgctccagcctgggcaacagagcgaaaccctgtctcaaaaaaaaaaaaaaaaaacaaagccggtcgggtgcagtggctcatgcctgtaatcctagcattttgggaggctgaggtgggaggatcacctgaggtcaggagttcaagacaaacctggccaacatggcgaaaccccatctctactaaaaatacaaaaattagctgggcatggtgtcacccacctgtaatcccagctgtactcaggaggctgaggcaggagaatcgcttgaacctaggaggcggaagttgcagtgagctgagatcgcacctttgcactctagcctgggcaacaagagagagactccgatttaaaaaaaaaaaaaaacaatccctggattggtagaaattgtctctgagatctgggagcattgggagcatttggtggccaatggggctcgcagatcccctgaagttggaggcaggtcactcaaatacccaacatgttgctctgcagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaaggtgaggtccctacacccccacagaggactgccctgggagatgtatgtcctctagtggcatgaggccctctgccttctctcctccagacgcacgttctaggaacaccttctgtgcctttgcatgcttagttcttacacacctgagacactggcccatttgattcctggcagcctctgacttacccctcagacctgaagttaattccccttctgggaaggcctcctggctacccgctgcctgagactctgaaactctgatacagtcatgcgccacttaatgatggggatacattctgagaaatagtccttagatgattttgtctttgtgcaaaagagtgcacttatgcaaacctagatggcacctagtctagatggcgtagcctgcccctaggctgccaacctgtgcagcatgtgactgtcctgaatactgcaggcagctgaacacaatggcaagtacttgtgtatctagccatagaaaaggtaaggtaaaaatacaatataaaagcttcgttataggccagcacagtggctcatacgtgtaatcccagcactttgggaggccgaggcaggtggatcacttgaggtcaggagttcgagactagcctggccaacgtggggaaaccctgtctctactaaaaatacaaaaattagccaggtgtggtggcacacacctgtaattccagttactcgggaggctgaggcacgagaatcacttgaaccctggagatcaagcctgtggtgagccgagatcgtgccactgcactctagcctgggcgatagagtgagactctcagaaaaaaaaaaaatctccattataatcttacgggaccaccatgtgcagtctgtaatggactgaactatcatgcagtgactatatttcacatctttaatatcctggtgttcactttgctttgtcatcttttgtaaaataaacctcttggtttaccctctcccaccccctacttcatcccctctctgaactatatgtgggaataccagcagttgccaaactcattctgtaaagggggctggatggtagatactccaggctccgtgagtcattgtttctgtggaagttcttcaactctgctgttatgtcaggaaagcagcttgggcactacgtaaacaagtgagtactgccatgctcctggaatagtttatctgcaaaaacaggaggcagaaaaagtagaaataggccaggcatggtggcttacatgtgtaatcccagcactttacgagtccaaagcgggtggatcgcttgaggtcaggagttagaaaccatcctggccaacatggcaaaaccctttctctactaaaaatacaaaaaaattagctgggcatggtgtcaggcacctgtaatcccagcttctctggaggctgaggcaggagaattgcttgaacccgggaggcggaggttgcagtgagccgagatcacaccactgcactccagcctgggtgacagagcaagactgtctcaaaaaaaaaaaaaaattagaaataacccaaatgtacatatataatgaatggataaaaaattgtagcatatccatacaatggaatatcattcagccataagaaagaaatggcaggccaggcgcaacagctcatgactataatcccagtgctttgggaggccgaggcaggaggattgcttgaagccaggagtttgagaccagcctgggtaacatagtgagaccccatttttacaaaaacttttaaaaattgaccaggcatggtggcacacctgtagtcccagctatttgggaggctaaagtgggaaaatcgcttgaccccaggaagtggagtgtatagtgagctatgattgtgccactgtactccagcctgaggcagtagagtgagatcctgtctctaggaaaaacaaaaaataatgacatacgtgctacaacatggataaaattgaaaatgttatgctaagtgaaagaagccagctggacgcagtggctcacgcctgtaatcctaacactttaggaggctgaggtgggcacatcacctgaggtcaggagttcaagaccagcctggccaacatggtgaagccccgtctctgttaaaatacaaaaattagctagcatgatggcgggtgcctgtaatcccagctactgctcgggaggctgagacaggagaatctcttgaacctggaagacagtagttgcagtgagccgagatcccaccactgcactccagcctgggctgctgagccgagactccatctcaaaaaaagaaaaagaaaaaagccagacatcaaagaccacatattgcatgattccatttatgtgaaatgtccagaataggtaaacacataaagaaaatagactagtggtgggtggggtaggtggggagtggcagtaacttctaggtacaggatttcttttcagggtgatgacgaaaatactctagacttaacatagcagtgatggttggacaactttgagtatactaaaacaactgaattgtgaattgtatactctagatgggaaaatttcatatgtggattatatctcaaaatttttttaagaaacaggcggtgctgggcgtggtggctcacatctataatcccagcactttggaaagctgaggtgggtagatcgcttgagtctaggactttgagaccagcttaggcagcatggcaacaccccatcatctacgaagcacacaaaaattagctgggtgtggtgatgcgcatctgtagtcccagctccttgggaggctgaggtgggaggattgcttgagcctggaaggttgaggctgcagagagctgagatcatgccactgcactatccagcctgggcaagagaggaagactatctcaaaaaaaaaaaaaaaaaaaaaaaaaggcagaatccagatttggcctgaaaaccagagtttgtcaagccctaggttacaccatctctagaaaacaaagcctgggagaaagaagaaaaaacaggttgatttttaatggtttagcttgcgtggatccaggtcctgacagttatggaatctttcaaggacacatttgaccagatgagatttggcaggcgtttgtgtagagcctcacagtccagacagtgcctcaccgtattatgatgtgggggtgggggcgggcttctggtgctcttgtcctccacacaggcctgaaacagcacaggactggggaggtaccattggaagcacccgcaaccctaaaggcactgaccctaacctcacgtctccccactagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtaatggctgggagtgagcagcagtgctgccacgtggccttggccttggtggcggcttcctctgggtgtgtggaagaggtgggcagggacttcagcagcatggagagccatatcaggtgggctgtctggttgggggagggcactacgtggagtgtttgccatccttctgccttaaatgtctcatttgaaatgttagaaccaaccaggtgcggtagctcacatctgtaatctcagcactttgggaggccgaggcgggcggatcacctgaggtcaggagttcaagactagcctggccaacatgggaaaccctgtctctactaaaagtacaaacattagtcaggcgtggtggtggtctgagtagtcccagatacttgggaggctgagacaggagaattgcttgaactgggaagcggaggttgcagtgagccgagatcacaccactgcacttcagccagggtgacagagtgagactctgtcaaaaaaaaatattagcatgtccactgagaggacaagtgggggtttaggacagggaccctttcccacagcagacctggtttccagcataaaggtctgatggggtggccagggaacaggaaggacctcctccctcatgcccatatcccggtggaatctttcatttttttctgcttcacctaaaaccttgaccttgatttgacctcgggccacatctccaaccttctctaagaatccaagctggaagtccagcttggaatccgagggagcatccgtgtacacagcctacttcaccatccccgaggtgccctccaaactgccccatgaaggaagattctagaaataacattgagcaccttctctatgccaagagctgtttgagctagacatgtgaagatgtcattcacccctagaccctgcaaggtagccaccgtcaagtccacttgacacatgaggaaactgaagcccaaggggtgaggtagttagcccacgatgacagggccagcagatggcaaacccggggtggagcctggcctccccgtagagaaggtgtttaacctcgtggcgcgccttccctggatgggctctgctttgggacagctgggcggatcttcctcccttccacccttacgggcagcttccctccctgtcctcgtcccaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccggtgagtgctggcagcgcagggtgtagggggtggctctccatgggtctggctctgaccctcggctgtctctgcagcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggtaaaaatggggacagggcatgggggtgcattcctggaatcccagcactttgggaggctgaggtgggaggatcacttgagcctaggaggtccaggctgcagtgagccttgatggccccactatactccagcctgggtgacagagcaagaccctgtttctttgttttttgtttttttagttttttggttttttggttttttggttttttttgagaccgagtttcactcttgttgcccaggctggagtgcaatggcgcgatcttggctcactgcaacccccacctcccggattcaagcgagtctcctgcctcaacctcccaagtggctaggattacaggcatgtgccaccatgcccagctagttttgtatttttagtagagatggggtttctccatgttggtcaggctggtctcgaactcctgacctcaggtgatccgcctgcctcggcttcccaaagtgctgggattacaggcatgagccactgcacccggtcaaccctgtttcaaaacaaaaaaaacaaaccgggtggcaagcagtgggtgagggttcctgctgggtgcagcctaggaaccccaagaaaaggagggtcctgctcaagtgctggtgctgggctcctcatgaaggcaggacacctcattcagtgctgaggtcaagagggaacctaggagttcacgcaaatccagggaaggcgtgggctcacctcctggggtcaggactcagggatccagtagcaggacactaccccaactaagctcccagtgagcgtgcagccaaatgcgtaactgtcgggctgttaaaagatgcatgggacacagctggcgggagtgggcagtgcaagggggcggtgagaactcaagttcagaaactgactgccctggcctgcgcccccgccctgctgtttgcagcctgtggacctggggaagggacagggtgctttcctcagtttccccatctgtaacatgaggaagacagcattttctccttcacaaggccattgaaaagatgcaatgagtgttagaacagtgcctctattggtcagagctcaatagcagctattaggattgggtgagataagtcatgtacagaaacagtgttcatgactgggtactgtggctcacacctgtgatcccagcactttgggaggctgtggcaggaggattgcttgaggccaggagtttgagaccaggctgggcaacataacaagactctgtttcaaaaaaaaaaaatttataaactagctgggcatggtggtacatgtctatagacccaactacttggaaggctgaggtgggaaaattgcctgagcccaggaatttgaggctgcagcaagctatgattgtgccaccacactccagcctggacaacagagacccacagagaccctgtctcggaggaagggaggaagggaggaagggaggaagggaggaagggaggaagggagggagggagggagggagggagggagggaggaagggaggaagggagggagggagggtcaggcgtggtggctcatgcctgtaatcacagcactttgggagactgaggcaggcagatcacttgaggtcaggagtttgagaccagcctggccaacatggtgaatccctgtctctactaaaaatacaaaaattagccaggcctggttgtgggcacctgtagtcccagcttgtagtcccagctactcaagaggctgaggcaggagaatctcttgaatccgggaggcggaggttgcagtgaacccagatcgagccactgcactccagcctgggcgacggagcaagactgtctccaaaaagaatattcaatactcccaagcatgtccctcacctcttagctgagagcagccagtgccctgatggcggcagacagctgccgacatattcccagggctgccgacatattcccaggcactacaacatcatagttaagagcacaggccccagaagcagctgcctggttcagctttctggcttgtcacatgttatatggcaagtcttgggccagccacttgacttccctggacctctacttcctcatctgtaaaatgggggtggtgatcattgccatctcatagggtggctgagtgggattaaaggagaacgtgtgttaagtttttaggaccttaccaggcatacattagcattctctattgcgagagaccctgcccggccacacaggatgggtgttgaagttcttctcggagagagttgctggctgggcgtgatcacacatgtagtcccagcactttgggaggctgaggttggggggttgcctgagcccaggagttcaagaccagcctgggcaacatggcaagaccttgtctcttctaaagagagattcctgggtgaaagcagcttccccattctgggcctgtttgttcacaggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagtaagtgaggctgggagctcggctgcctataatgcccatggcaggccactgctgggaactggataacctggcatcccttgtggactgcctgctgccatccctaccctcaaagatctattccctacccaacagatcaggtgacccacttaaaatgtgaatcaggctgggcgcggtggctcatgcccgtaatcccagcactgtgagaggctgaggcaggaagatcacttgaagccaggagtttgaggctgcagtgagccatgattgcgccactgcactccagcctgggcaacaggcctgggagactgaccctgtctcaaaagaaaaaaaaaaaaaaaagcacgtatcagatgtggctcctgcagcctcccatcttgcatgtgataaaacctaaactccttcctgcagctccagccggcctcccccgatttgccttctagcctcccccttccatgctcctcgtccctggaacatgttccagctgacatgttccagccccactggcttcctctgctccttcaatgcacagcttggacccacctgaaggccttttgcaatggctattcctgctgcccagaaagcttccccccgcccctgagctcccttccaggcaggcttctccttctggcttcagcccaaagatcccctccttggggaacacttttctttctctcacagctgaatagcaccctctttgcctggtctctcccacacttgtcactgtctgaaatcctccttgtatacttgttcttttcccactcaagtggcgtgaaagtagggggccgcagtcacgcctgcatttgtccggcctagaatgacactggcttgtggcgcgtataccattctgggttgagttgcgtattgggtgccttctaggggctggggtctgtcctgggcaccggtttggttggtggccgctgcccttggcgctcctgttcctgctctggccccatgccagcctctcacctgcgctccgtctcctccaggcatgaggctcagagactggagcaggaagcccgcggccggcttgagcggcagaagatcctggaccagtcagaagccgagaaagctcgcaaggaacttttggagctggaggctctgaggtgggttgagaactagaggaggagactggcaggggccgagggtcttaggacagcagctggtgtgggcagcaggcctgggtggggtgtcgatgagacagtgcacggctacagcataagccaaggccgtggggggactgggctgtctcccgggtcttacctgactctgccttctccccagcatggccgtggagagcaccgggactgccaaggcggaggccgagtcccgtgcggaggcagcccggattgagggagaagggtccgtgctgcaggccaagctaaaagcacaggccttggccattgaaacggtgagtggggggaggcattaagaagagggtggccttgagtcctggaaaaggcccattccctacagtccctgagactgtataggacaccaggtcccccaacataaagccctatccaagtactttgcatttgcaaagtcctttgccttgtaggattcattgactccattgctggaaggtaaggattagaacacccattttgcagctgggcgctcatgcactggccaccttggcacaagtgctgtgtatgcttcataggcattatcttatttaatgcttgaaatcccattaagaggccgggtgcagtggctcacgcctgtaatcctagcactttgggaggccgaggcgggtggatcacctgaggtcaggagttcaagaccagcttggccaacatggtgaaaccccatctctactgaaaatacaaaaaattagctgggtatggtggcatgtgtctgtaaccccaactacttggtaggctgaggcaggagaattgcttgaacccaggaggtgtggaggctgcggtgagctgaggttgtgccactacactccagcctgggcaacaagagtgaaactccatctcaaaaataaagtaaataaaaataaatgtaaaaagaggcctagtgtggtgcctcaggtctctaaccccagcactttggaaagctgagatgggaggatcatttgaggtcagttcgagaccagttcaagactagcctgggcaacatagcaagacctcatctctacaaaaacaaaattttttaattgactgggtgtggtggcacatgcctgtagtcccagctacccaggaggctgaggcaggaggatcctttgagccaggagttcaaggctgcagtgagtcctgatctgcattccagcctgggtcaaaaaataaagaatgattgatttttcctcttccaggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtgagagttggggaaggtgtgttggtttcaggaccaaccttgaaaccaggaaggcagagccaaggcggaaaacacaacatctggaaagattgtggggaagggaggggtgagtgacctgacccacgatgcagggacattcacacagtgtcacgctgcatcaacgtcaggcactgtactagacccagcagtgagccagagctccggaggagacaggaaatggatgggacgccagtctgacaggcatttccaaggcagtcaagcagggtggtcagatgcaggggaggtgacccttcaaaccagctgacttaaggagggtcactctgaagtggccagggtttgacgcccatctcaacttcctcctgttctcaccctccaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaacacttttctcttgtctgacattggttggggttaccagggagcttaatggtggggaggggaggtgcccctggcatcttttttttttttttcgagctggagtcttgctctgtcacccaggctggagtgcagtggtgtgatctctgctcactgtaacctccacctcccaggttcaagtgattctcctgcctcagcctcctgagtagctgggattacaggcacgtgccaccacgcccagctaatttttgtattttttagtagagatggggtttcaccatgttggccaggctggtctcgaactcccaacctcaggtgatctacctgcctcggcctcccaaagtgctgggattacaggtgtgagccactgtgcccggtcaacatctttagatagttacaggagactcttctcctccataaaggggagaggaccccgaggcaggggaaggatgagctggaagtcacccagtaggaatgtggccccaaagccttgtgcactgggcttcctagagcccagataggggtgatgatgccacgggtgggggcatggggcccacaatggcaacatctcaccactggttctccaggagcccagctgcctggtagctctcagctgttgcagatgcaacccagcttcccattcgggaggcgccctccagcgccacctgctggagcacccacagcaccagcagacgtgtcaggcttgcacccggtgctgtgcgcttgtcccttcccaggtgggggtgtcaggttggggaggaggaccctgcctagggcagtaggaattgggcatctccttgagcttccggtctgggctgtttgggagcactgaaggaggagtgcccttatcccaccttctcccccacaaccagtatggggtcctcatttgagagaaggatccaggtgcagtcagcctgggtgcactagccctttggggccaggaacagttgtaggtgccaggcctgccccgtctctgccgaggaagtaaaaagatcccaggggccgagtgcaagagcttaggcctgtaaccccagcaccttgggaggccaaggcacaaggatcacttgagactaggagttcgagaccagcctgggcaacatagcaagacccccatctctaccaaaaaaaaaaaaaaaaaagcaaaagccagatgttatggcatgcatccgtgttcccagctactcggggggctaaggtgagaggattgcctaagcccagaagttggaggcagcagtgagctatgatcataccactgcagtccagcctgggtgacagagggagaccctgtctctataaaaaaaaacaaaacaaacaaaacccttaaagcctccctaaagccctcattttcaccttcctgtaatattgagtggaaaaagcccgatccccccttaaaccacctccctccctctctgccctgcccctgaccgttgctgcaggaggaacaccccacggagctgactgatcttattttaaactcatgggaacaaattttgagggaggtgcagcttctctggctgtgctgctctgtcttgtgtgcgatccgctttgagacaaccattcacaccacctctcctctcagcctcctacacccctgcccactttctctcacctctttgagaaaatagaagcaaattgggtaggaaggcccttcccagcaacaaacctaacaaactgctggcatctagactgtcctccctcctcttcccaccctgggctcctccccttgggctctaggagagagggctgcattccttcactgattgccgtcctctcctgtgctgtcaatttttttttcttttttttttttttcttgagactgagtctcgctctgtcacccaggttggagtgcagtggcgtgatctcagctcactgcaacctctgcctcctggattcaagtgattctcctgcctcagcctcccgagttgctgggactacagtcatgcaccaccatgccctgctaatttttgtatttttggtagacatggggttttgccatcttgtccagactgatcatgaacccctgacctcatgatctgcctgccttggccccccaaagggctgggataacaggtgtgagccactgtacccagctgatatgccatcaatttcttctctcctgcatcatcatcatcaggatatagacatgtctactctgtccatataaaacaactcccttaaccctatgagcccctctaacttccacctctcctttttccatcacagccaaatttttccagagttctctgtggtctcactttccattcctcatctctcattatctcttcaaaccactccagatagggccaaacgtggtggctcacgcctgtaatcccagcactttgggaggccgaggtgggtagatcacctgaggtcgggagttcaagaccagcctggccgacatggtgaaaccctgtctctactaaaaatacaaaagtgagccaggtgtggtggtgggtgcctgtaatcccagctactcggcaggctgacggaggagaatcgcttgaacctgggaggcagaggttgtagtgagcgagattgcgccattgtactccagcctgggcaacaaaagcaaaactccgactcaaaaaaacaccccagtttgcttctgtctctgccccttactttatggaaactgctttattcggcatcaccagtaatgtcccgttgctaaatccagtagttgatcggtcacttggcacagttggccattcctcccatgctgggctttcctgacatcacctgttctagttttctttctcgcttctctcagtaggttccctaaggcccacttctcatgctgacattcttgtccaatcgcatgacctcagatggtctctataccactgacctcagaatccattactccagctccgacctcacccaagagctctggactcatttccaatccatgccttgatgtctccacgtggacctcaattggtgatcaggctttggctcttgccaatgaaatgcaaggggaaatgacatcacatgcctgttcttcccttttccatataaatgggtgaccagcaatgttccaagtggaagctgctccaaccacctgggtcccagggagaaaatggcatgaggtgcagccacagctgacctgcaacagacatgtggcaggagtgagaaatgtttgctgtattaagcaacggagatttggggggttttgttaccacagtataacctagcctatcctgactactttgtgtgcctcacaggattgtaagatctcataggtcataggggaaactcctctaaattgtatgcaaggggccaggtgcagtggctcacgcctgttatcccagcactttgggaggccgaggtgggtggatcacctgaggttgggagttcaagaccagcctggccaacatggtgaaaccccgtctctactaaaaatacaaaaaaaaaaaaaaaaacacaaaaaaaactaggcgtggtggcacacgtctgtaattccagctactcaggaggctgaggcaggagaatcgtttgaaccccggaggtggaggctgcagtctgccgagatcgtgctactgcactccagcctgggagagggcaaaactccatcttaaaaaaaaaaaaaaaaaattatatgcacgaagaggggcccagcacaggccatagagtggggaagacaggacttgctggaaatacagtgagcttctgtctccaaaaaaaaaaaaaaaaaaaaaaattagattaatttttttttaactttacatttttaaaattttaattattaggtttaacctcaaatttttttttttttttttttttgagacagggtcttgctctggcttggtggttaaatattttgaatttcatccctggggcttagggttgccccaagcaacctgtttactgaaagaagcctgaaatatacattgaatttttttttctttttagacagagtctcgctttgtcgcccaggctggagtgcagtggcatgatctcggctcactgcaacctctgcttcccaggttcgagcaattctcctacctcagcctcctgagtagcgagaattacaggcgtgtgccaccacgcctggctaatttttgtattttttgagacagagttttgctactgttgcccaggctggagtgcaatggcacaatcccggctcactgcaacctctgcttcctgggttcaagcgattctcctgcctcagcctcccaggtagctgggattacaggtgcctgccgccacacccaggtaatttttgtatttttagtagagatgaggtttcaccatgttggccaggctggtcttgaactcctgacctcaggtgatctgcccgccttggcctcccaaagtgctggggttacaggcatgagccacagcgcctggccctagttttttatatcttaaaaattaggcctatgtctaatccaaaaaaagtgtttttagattaaattagctaggtgtggtggcatgtgcctgtagtcccagctactcaggaggctgaagtaggaggatcacttgagctcaggaatttgaggctgcagtgagctatgacggcatcactgtactccagcctgggcaacagagtgagaccctgtctcaaaaacatacatagagaacagtgtgatctctgaagaagttcaacacagcctgtttttctctagcactagaacaaatggcttttctttggttgaataccaaagtaattgatgtgttgaaggaccccctttataagaaaaatctgtgtctttcaacagcgaacacattcagcatggtaagatgctgtttaccgaatcagtttcctcttccacttacgcccacaactaatctgtgtcccagcttcccttgtcctcagacactgccgtgtgaccgagttgtagccaatggaatggaagtggaagtaataagtgctaatttcctgtctttccataaaaacttggctcctgcaacctccatacacatcatctgcctacatgatgcaaacaagctgggcagtcccaggagccacgtgttgaaaatggcagaatcacagaacaggagatgcccgaattcctgaatcgccgcttgcaggagagctgtctcccagtcggcagcatctgattaagatttaatatgagttagaaataaaataatgttctttcttttttttttttttttttgagacagagtcttgctctgcctccaggctggagtgcagtggcacggtctcggctcactgcaacttccgcctcctggttcaagtgattctcctgcctcagcctcccgagtagctgggactacaggcgtgcaccaccacacccagttaatttttgtattttttgtagaaatgaggtttcaccatgttggccaggctggtctcgaactcctgacctcaggtgatcccccacctcagcctcccaaaatgctgggattataggtgtgagccaccacgcctggccaactctttaactcttttgtagcaatggggacttgctatgttacccaggctagtctcaagctcctgacctcaagtaatcctcctgtttcagcctcccaaagtgctgggattacaggcatgtgccaccacaaccagtctagaaataaactatcatgtttgaggcactacacatcttgaagtttgttacagtagttagggttatttttaatcacagaaggagagccttgaagactgagactgcctagaggaacagcaaatgtacaggtactgatctcctgccctccgaggcgcagtcattgagtggaacaaacaaatgaaacttcttacacagtggcgtggtgatcattcatttattctgaaggcatatagctgattccagaaggctattactgcacatataacgtgactccactatgttccctagatcaaatatagatactccagggcccaggtcagctcagcctttccccactccccacctccagatcaagggctctgcaggttcttcctgagcccaggccagccactggacatggaacgccggcaccagtctgactgcgagccacgtccctgtaggccaaggggacttagaagccctcctgtgagtcttcagtgctaccctacaagcctcaggatgctcgggtgcagattcttttagactgcccgtgctcacactctcctcctcaactctcttttttaagatcacatatggccaggtgcaatggctcacgcctacaatcccaccactttaggaggccgaggcgggtggattacctgaagtcaggagttcgagaccagcctggccaacatggagaaaccccatctctactaaaaatactaaattagccgggcgcggtggcgggtgcctgtaatcccagctactcaggaggctgaggaaggagaattgcttgaaccccaggggcagagattgtagtgagccgagattgcaccactttactccagcctgggctaaagagtgaaacttctgtctcaaaaaaaaaaaaaaaatcacatatggccaggcatggtggttcatgcctgtaattgcagcactttgggaggttgaggtgggaggatcacttgagcccaggaattcaagaccaacctgggcaacataaggataccccatctctacaaaaaaatacaaaaatagtgtgctgggggtggtggtgccgcctgtagtcccagctactcaagaggctgaggctggaggatcacttgagcccaggaggcagatgttgtgatgagtcgagatggagctactgcactgcaacctgggtgacagagtgagaccttgtctcaaaacaaaacaactcaatgtagctggatttacacagtcagccttctgatgtcactgtaaatggttagagccaaggagcctaggagccagccagggacatgggagtcaggcaggccaagggctctgtcctctggggctggagagagaggacccaccaggctggaggaagagccaacaggaaggagaaagggctgcagggcaggcacagggacagcccctgacccagtctcctaccttgactgcagcaggccaggtagtggggtgcccacagctggaaacgcacctcagttttttgttttttgttcttttgagacggagactcatctgtcgccaggctggagtgcagtagcacaatcttggttcactgcaacctctgcctcccaggttcaggcgattttcctgtctcagcctcccgagtagctggaactacagtaggcgcgtgccaccacacccaggtaatttttagtagagacagggtttcaccgtgttagccagggtggtctctatctcctgacctcgtgatctgcccaccttggcctcccaaagtgctgggattacaggcgtgagccaccacacccaccgcacctcagttttgtgcaccaatagcttcttcaagcacaggtctgtccctgccactgtcctgctttaagcccctcaacgttcatcctatacgtgtcccccaaaaagcgcgagatgatttaccgcagcaccattcacagtggtaggaccaggttaaactgaatttttttttgagacagagtctcactctgtcacctaggctggagtgcagtggtgcgatctcagctcactgcaacctctgcctcccgggttcaagcgatcctcctgcctcagcctcccgagtagctgggattacaggcgcctgccaccacgcctggcgttctatgcaaccattcagaagcccgctggcgtgaaagtactgcgtacaattaagtgttcaggtacaggctctggaaccagactggccaggctgccacctctcggggcctgtttcctctctggggaatgagaacagtaacagggctgtcgtattgtgtgcaactgtacaattgtgagataagataatgcacgcaaatagcacttagagcagggtagcttgtgttagcagaacagcacatacataaaatgaatgttaagatatggaaatgggctagacacagtggctcacacctgtaattctagcgctttgagaagccaaagcaggaggatcacttgaggccaggagtttgagaccaacctgtgcaacacagtgatacccccatctctacagaaaaacataaaaattagccgggcatggtggtgcatgcctgtagtcccagctgttcagcaggctgaggcaggaggactgcttgagcctgagaggtcgaggctgcagtgagctatgatcatgccactgcactccagcccaggtgacagagagagaccctgtctccacagtaaaattttaaaaagtcctctgggctcctaggccgccccagctggcttctgcgtcgcctctcaccagctctcccagcccccaacccccactcccccaacctccctggagcacttggtgctccaggccctgtgacctagatctgtttcttttttttttccccaccttgactggagcaggccaggttggcagggatggtaggggtgcctgatgcgcttgaaacacacctgctttgtgcacaattttttttttttttttttagacggagtctcgctctgtcactgggctagagtacagtggcatgatcttggcttactgcaacctccacctcctgggttcaagcaattctcccacctcagcttcctgcgtagctgggactacaggcgtgcaccaccacacctggctaatttttgtattttttgtagagatggggtttcaccatgttggccaggctagtctttaactcctgacctcaaatgatccacccccttgggtggatcccagagttctgggattacaggtgtgagccactgtgcccggcctagatctgttccaatttctgttgtcactgtaaatggttagaaccaaggagcccaggagccagtcagggatgtgggacccaggccgaccaagggctccgtgctctggggctggagagtgctcagaggacccaccatgccggaagaagagctgacaggaaggagaaagaggtgcagagcccaggggcctctctggcctccctgccttcccatgccattccctcagctaagaaccaatctcctctgcactaaccctttcctctccaatccctaccagccttctacatgggatacccagccccttcaccaaaccctaaatcaggtcctaggtgtcttctactcccacccccaacgagcactttcctatgttattgtagaggaagccagctgcccagtacccagtgaatcccctgggcctagcacaggagttgaggctcagtacatgtctggtaaatttctgctctcctggacacgggggcctcttgggccacttggctaagctatcatgcagatagaatgagtaacatctgcaaagaacccgcagcacagagtctggcatgcggtacagtagtttaaaaaccacagatggcaggggatagatgcccagaacagtgcctagtatatgataggagcccataaaaagagggaacagtgtttctcaacattactggaagaattccccggcattcaagttgcaggtttctgagcccatccctagagcttctaactctgaaggttggctgcagggtccaagaagttgcatttattttattttttgagacatcttgttttgtcgtccaggccggagtacagtagcatgatcatgactcactgcagccttgacttcccaggctcattcaatcctttcactgcagcctccccagtagctgggactaaggcacacaccaccacacttggctaatttttgtatttttttttttgtagagacggggtcctgccatgtgacccaggctggtcttgaactcctggactcaagtgatcttcccacctcagcctcccaaagtgctgggattacaggccaggcgtgagcctccaagacgggccaaagttgcttttttttttttttgagactgcctggctctgcctcccaggctggagtggcaccattacggatcactgcaacctctccctcctgcctcccaggctcaagccatcctcccacctcagcctcctgagtagctgggaccacaggcatgtgccaccacatttggctatttttgttattttttgtagagatggggtttcaccatgttggtcaggctggcctcgaactcctgtactaaatccacccaaccttggccttccaaaatgctgggattacaggcatgagccaccacacctggcttgaatttgcattttaaagaaatatccagccaggctttgtggctcatgcctgtaatcccagcactttgagaggctaaggtgggaggatcacttgaggtcaggagtttggggctgcagtgagctatgattgcaccactgcactccagcttggacgacagagtaggactctgtctctaaaaaaaaaaaaaaaaaaaaagaaagaaaagcaaaaaagagaaatagaaatataccacaggtggtctaaggaccacactctgagaaaccaactcattgacagacgagtatttattaagcagctactatatgccaggttcaagttggtcttactctagggatagagaagagaacaagaaaagtctgtgccttcatggagtttacattctagtgagggtagaaaatatcaagaatataaatacatgtagacagtcagtgacatcaaacaagtgggcggtggggacaccacatgagcatgggtggcaggagggcctctctgtgaggtcactgtgggtagacggagaagccagccagcaaactggaggaaaagcacccagacggacgtccttccctaagctccctcaacccaggccctgagccaagaatatctgaaaggaaaccaagtcaaatagtgaagtcccgccaggaccagggtaggcaggacagaggagccggtgacagggaaggctgtggatggcttcttccctcctgggcatggtgccccaagcttgctctggctgggggcggaggtctgactcccgcctttcaggaaacctggccctcacaccacctccctcactcaagcgtccctagcatctcggaccccaggactgagcaggcagggtgtgacactgcccggtcccggcaccccaggagcaccgcctggatggagggggcctcccgcgtatcctccctgatttgaggcccgggtcctcaggatcccagagaacgtgacgtcaccaaagagaggctgacccccatcccagcaggtagaacaacacatgaggaaggcgtgagactgggacctcctagcagggggtggggagctgtgtggcacagcaagactcccagggcaggtgggcagccaggacccggggctccagcgtcacttcttcttggcgcggtctgctgcgtccagggcagccatgttgcgggcggccgtgatcaggtggatgacgctgatgagcgacttcagcaaggcgatgggggcagtgacccagaggcccatccggaacagtcccacagagccaactgcaggaaggcagcaggggagtttggggcccgaaggagggggcctccatctccctgggcaggccagatccccctcccatcctcctgcccagcccctcatctcctacctaaaggtccctcagagaaatggaacaggtagaggaggcagtagaagagctcattcccagcacacaaggtgaacagagcaggctgcacacacagcaaacaggccacgttagcaagaggcaggcgtgtgccaccccctgcccccccagcactaatgaaggcacaatctcggcatattacttctcttatttttttttcttttttacagacagggtctcgctctctcatccaggttggaatgcagtagtatgatcatagcactgcagcctcaaaactcctggtctcagccaggcgtgtggctcatgcctggagtcccagcactttgggaggctgagacaggcggatcacctgaggtcaggagtttgggaccagcctggccaacgtggcgaaacccctctctactaacaatacaaaaattagccgagtgtggtggcacgtgccggtagtcccagccactcaggaggctgaggcacaagaatcgcttgaacccagcaggcagaggttgcagtgagccgataacccgccactgaactccagcctgggtgacagagcaggactctgtctcaaaaaaataaataaataaataaataaacccttggtctcacgcaatccttccaccttagcctcctaagtagagactacaggcgtgtaccactgtgcctggctaagctaattcaagattttgtgtgtgtgtggaaacagagtctcactttgttgcccaggctggtctcaaactcctggcctcaagcaatcctcccacctcagcctcccaaagcgctgggattacaggcatgagccaccatgcccagccattatctttttaaaaatccttccagaggctgcctgtgttcctggaatcaagtccacactccagccctgcagacctctctggcttatctcccttcccgctttcagtcccttctctttgcaggcctcattcccacttgttccctggagtaattcacacaggccttccccaccaatcctcctcctccacgcctcagcttacgggccctcctcctggagtgactgggcaggccctgctctgcgccctcgccttctcctaggctaggaccaggattcagcccagggcttcccacagccaagagcctgaggggtggggtgtgcaggaaatgcttaccctcgaggtgtagtagatccgaagcaccggattcccggacaagtcgatcatcttgtgactctcactgcctcggaccacagaacttggggagaaaacaggggaacccacaaggtttcatgaccactaccatgcatccaatcctcatgttaacacctattgtacagatggaaaactgggcacggctaaggaccagtatcctgccgaaagccacagttacctatttgggggcagagtcaggattcaaatgccacatttgaaagctcccatgccccttcctataagctgtcacctatatggaatcctagaatacccagccagaagagtcctaagaattgcttaatgcaactgtaaacatgactgaagctttaaagagaggcaggtttgcctggggtctttctacaaagcagagctaaaaaggagcccttccaggatgcctagtgccatcccagacacccttccgtctaggctcagcccaccccactgtaatgtctccaagtggcccaggcccccagaatcgcagcagacctgtggaggtgcagccagtgactggccacatccaaactcatgctgatttggaagaacagcgtggctccagggtacagcagggccaggttgaccaacaggcacatggtggagcagcggtccgtcagcatgtccagcatggccccaaaccgggttcctggaagattaggtgggcaagggctgttatggcacagtggatgcaggacaggtgcccatatttggtttatcactctgacgcagggtgtaaacgaagactggaagtgtccgcctgcctggggaggaacgcaggctagaaaacaggctgtgtgtgaggtcagtgggcaaaggtcaccatggcatgaactgagaaaggcatgagagtggagggaacagggtaggaggagaggaaagctatgtctgcaactcatcaaccccagaaccaagactccagggctagatagagacttgatgcctcaggggaagccttacagttgggtctggagaacagattaaaaaattagtcaaccctccagaagccatcacccttccctctccatcctccctctaagcatgccttctggaaccccaactgcttatgcagggcacacagtaggcctccagtaaacacctgttgaatacactgttttttgttttttgtttttttttttccgagacagagtcttgctctgtcgcccaggctggagtgcaatggcgcaatcttggctcactgcaacctccgcctcccgggttcaagcaattctcctgccttagcctcccgagtagctgggattacaggcacgcgtcaccaagcccgctaatttttgtatttttagtagagacagggtttcaccatgttggccaggctggtctcgaactcctgaactcgtgatccacccacctcggcctcccaaagtgctgggattacaggcgtgagccaccgcccctggcctgaatggacttgtattcagagagacctccagcagcgccaccgccatgtcatgtcttgctaatccacacctctcacaagcagtgagttctcaagagctagcttaaattccttttgctacaaaatcagtccattcttgctgggcgcggcactttgggagcaaggcaggaggatcgcttgaggctaggagctggggaccaatctgggcgacactgcaagacccagtctctacaaaaatttaaaaattagccgggtgtggtggcacgctcctgtagtcccagctagtcaggaggctgaggtgggaggattacttgagcccagaagatgggggctgcagtgagccatgatcgcgccactgcactccagcctaagtgacagagcgagaccctgtctcaaaaacaaaaaaacaaaacacaaaacaaaaagccccaggccatcctgttctgctttttccagagatgggaatgacagccctctgactctgaggtcccgaggaggcaggggaagggaggaggggattgttgaaccccaaggctggctgagaggggtgtctgtcaccttgattaagagcgcgagcagcgtgtccatcgaaagcgtccagcaggccgctgagcaggtagaaggaggaggccgtgagggggcagcagggcatgaagtagaaagaaatgatggcgaagacaatccgggcataaccttggaacgggacgcggggagacagggcaggatcagggagcccgccaaggcccctcgccctctcgttcggcccggggccgtgggcagcactcaccgatgaggttgggcacgaacaggaagatattttcgtctggcatcgcggcgcctcccttgctgccccgggcctgctctggagatgccagtgctgtcccagccccgcagcgcggcctcagcctccggcccggcgcatcggccgcaccacctgcgccctggaccccgccgccccaacctggccccagatgctgaagcccgcagccgtcgggagcatggaccggccccgaggtgcgcgggacgcagggggcgcgcgcagtccgcccttcctacccgcaacctccctcgcctctgccagccccgcaggcgctccgggcctccagctgcggtcgccgctgctccagctgcgcgtggcttccgggaacctcctcctccgcgcccgtcgttgcaaaattggagagaggaaaaagtggcttaaaaaaatagttgcggcccctttaaggcctgtcggcttcctttcccttttcctccctccgcccctctcccttggctcgtaccaaagcgcagaggaggagagggaggaaggaaccattaacgtcaagcaaagttagaaacggaaaaggaaagggtaaaagagaagaccgaataaaaatctctgctttccttttgtggagggtatgacttcctggaggcaaagataaggcgataaaattcctcctcctgagtctttgcgtccccaagaggccaggagatttggtgcagtcctcactttactccccgccccctaagtctccagccgcctttgctctcgcaggctctaggcggctagagaggctccagagcgccctgcagatgggttgcttttcgcgtgccccttgtgatgggaggattaggtcgcaggctccaccctacgtcatcctcccaagcttctcaagcgtctggcgcttggggtcactgccctcaaggaggcacctggaggggtacggaggggaggctggaggagcaaacggggcgcgctaggaaattcctctgtctttagttctagaacccctgatctcctagcaacgaggctgcggaacctctgcagactccaagggttttatagcgtccggtagcgacacggagccggctcccccttttccagccttcctccccatctcccattctccatcccccacgacctataccagaggtccttaggcctccacgtctctccttttgccgagtagcccaaggtttccacccatctgccaggtctggggcgtcaagtcggctgcctcggcttgggaaggtgcttgggagggaagaaggaaggagaggcccaccaggcgaaggggtgaggggtagggggttgcgggagttccctctcactcccgaagatataaagcaacctttattattattattattttttcttgtgagagggaatgaggcagcgggatgtttcctctaaaggccttgtttaaacctgggcccggggaatggtggtggactgggttctgggggaaagcgggctggtttctcaggtcaactcaggcttcgactgttcccagggggatggcgtccactccgatggggaatgagggggagaagaagagcagctggccatctcaagctgcaccctccttgagaggaggtccggtgagcactgcagggaaccctagaggtgggaatgtaatgaagtgaaagcctcccaggcagaggcaccccgtgccaggtctgagccacgggccctgagactctagcctcaaccctgagtcctgaagccccgactcatagctctcagcactaggccctgactctaaacccccaccaaacccccctcccccaggtccagagctttctagctaaatctcaaggcccagtccttcaggagcaagctccttggacccacaggccccagcctgggaactcccacagccagcactcccatgtgggagctcccaggctgaacccctccggcttttcctttcccaggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcggtaaccccctgcctcaggaccaccgtgtctagagaaccgctgcccccactatgcctggttacagtccctgacccctcccacccctagctgaactctccaggagtctgtgcccatctcatccatctcacagccagccctaggacctgtgaaatgcccctctcacccgctaacccagtacccactcctcactgctggccgagaatccccttagccccgtctgccctggccgcatctcttctggccacggggatagtcctttctctgactaggtcctctacttccagcattcttcaccaagacctgaggcacagacacctggtgagtgaggcttcaagggagatgctctttgtcctgggagagaggtgaggaacctggaggggagagagtgagggtttcacaatatcccagcagggtgggggaatttttgaaccgtgcacttccattctattctgccctgatcctcaaattctgaattctcagccctctcccctctcttccaccatctcctgctcggacagaaaccgtacctgcagcaaggcatacctcctgccaactcctggtgaaaaggtacatgcagggtccatggctgccaaggctattcgatattaaccaaaccttttgagtttgcactatatgttggtccctgtcttaggagcttgggacactgaaatgaatggtacagtctcagcccttgaagagttcacagttcagtgtggggacagacaaggaaatggccaattataatacagtctggataagtttccataatagaaatggacacagtgggatagtactcttatcccagcttcaattggacaggaaggacaggagccatggagcttcttctttttttttttgagacggagtcttgctctgttgcccaggctggagtgcagtggtgtgatctcagctcactgcaagctccacctcctgggttcacgccattctcctgcctcagcctcccaagtagctgggactacaggcacccgccaccacacccgactaatttttttgtatttttagtagagacggggtttcaccgtgttagccaggatggtcttgatctcctgacctcatgatccgccctccttggcctcccatagtgttgggattacaggctttggagcttcttgaaggaggtagcacctaaagaaataattttccaccaggtgcagtggctcacacctgtaatcccagcatttttgggaggctgaggtgggctgatcacttcagggcaggagtttgagaccagcctggtcaacatggtgacagaggttgcagtgagctgagatcataccactgcactccagcctgggcgacagtgagaccatctcaaaaaaaaaaagaaataattttccaggttaaaaaaaaaagaggttagtaggagtctttcaagcagttggggttgcatgaacaaaggcaaagagcagtcttcgcagagccagtgtgagcatctgtgtgtatttagggcagggagaagcagtttagcagctggagtctacaggcaaggtaagaggggactcaagagactttatgtgccttgtttagagccttacacactttcctggctgggtgtggtcgcttatgcctgtaatcccagcactttgggaagctgaagcaggaggatcgcttgcgtccaggagtttgagaccagcctgggcaacatggtgataccccaggcatgatggcatgtgcctgtgatcccagttacttgggaggtgggaggatcgcttgagcccaggagttcaagaatagcctgggcaacatagagagaccccatctctataaaaagttaaaaaaattagccaggtgtggtggcacgaacctgtggtctcagctacttgagaggcggaggccagaggatcacttgagcctaggaggttgaggctgcagtgaaccatgttcatgccaccgcattccagcctgagtgacagtgcaagaccctgtctcaaaaagaaaaatttaaaaaaaagaaaagaaagaaagaaatagtaggaggagctgggtgcggtggctcatacctgtaatcccagcactttgggaggccaaggcgggtggatcatgaggtcaggagttcaagatcagcctggccaacatagtgaaaccttgtcttaactaaaaatacaaacgttaggtcaggcgcggtggctcacacctgtaatctcagcactttgggaggcccaggcgggcagatcacctgaggtcaggagtttgagaccagcctggccaacatggggaaaccctgtctctactaaaaatacaaaaattagctgggttggtggtatgcacctctaatcccagctactcaggaggctgaggcaggagaatcgcttgaacccaggagttggaggttgcagtgagccgagatcacaccactgcactccagcctgggctgcagagcaagactctttctcaaaaaaaaaaaaaaaaaaaaaagccaggcattgtgtcacgcacctgtaatcccagctacttgagaagctgaggcagagacttgattgaacccgggaggtggaggttgcagtgagctgagattgcaccactgcactccagcctgggccacagatcgagactctgtctccaaaaaattaaataaataaaaattaagcacttactatgtgccagcactgctcgaggggctggggtgttgcagtgaacgaaacagagttcctgctatcaagaggtttaaaaaattagccgggtatggtggtgcacagctgtggtcccagctactcgggaggctgaggtgggaggatcattggagcccaggttgaggctgcaggaagatatgattacaccactgcactctagcctggctgacagagggagacctgtctcgagaaaaataaaaaagacatgagccttgggtctaaagagtgaaaaggctctgtctcttttatggagctcttcctaacagtcagtttggaagatgagcccacccctctttgatgctcttggcttctcatgcctccccctttttgtccctagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgcattgctcatgtgtggtttctctggggtagagaagcaggacgggggggcttttatttttttttctagatgtgggtgctggatgtgggcatacgattggagtgtttagtctttaaaaaaatttttttgtggccaggcacggtggcttacgcctgtaatcccagcacagatcatgagctgaggatatcaagaccatcctggccaacacggtgaaaccctgtctgtactaaaaatacaaaaaattagccgggcatggtggcacgtgcctgtagtccgagctactcgggagggaggctgtggcaggagaatcacttgaacctgggaggcggaggttgcagtgagctgagatcgcaccactgcactccagcctgggcgacagaacgagactccgtctcaaaatttttttgtgtgtgtggagacggtgtctcactgtgttgcccagactagtcttgaactcctggcctcaaatgatcctcctgcctcggcttcccaaagtgctgggattactggtgtgaaccaccacacccggcctgttgacacagatgagctcatgggtccaaatccagcctcctggccacacgccagcaccttaaggtctaggtctgtggcatctggcaggactcctcttgcttctgaggagccacctctgccaccaccattggggatggggacactgagctatggccttgcccctctgagctttgggcttcatgcctgtgagaacatatcacactcattactagccagaaagcagtgcagtaggctttgcagtaggctaaattcattttagcatttagcatttgcattgctaaatgcaaactgcacaaagtttggccatttattggagcctcctgtggaagtcaattctcatctctgagccttagtttccttatctgaaaaaatggattaataaatgatccctgtcccgtagggtcctttagagagttaaaagacataattgagtcaggcatggtggctcatgcctgtaatcccagagacacaccggacagtatggcgggaggatcgcttgaggacaggagttcaagaccagtttgggtaacagagtgaacccccacccctaaaaaggtaaacaagttagccaggtgtggtggagcacatctgtagtcccagctgctcaggaggctaaggctggaggatcacttgagcccaggaggttgaggctgcagtgaactatgatggtgccactgtactccagcctacactacagagacaccgtctctaaagaaaaaaacataggccgggcgtggtgactcatgcctgtaatcccagcacttgggaggctgaggcgggtggatcacttgaggtcaggagttcgagaccagcctagccaacatagtgaaaccccgtctctaataaaataaaaaaattaaccgggtgtggtggcaggctcctgtaatcccagttactggggaggctgaggcaggagaatcacttgaacccagtaggcagaggttgcaatgagctgagattgcaccactacactccagcctgggtgacagagtaagactcagtcgcaaaaaaaaaaaaaaaaaaaaaagacaaaaaaacaacataatgcatacaaagtgcttgctattattgagatcagtttgcctcacattctcctaaaagtccacccctttctgaatatttcagcatcctttcaagtatcctaaaaatgtttaattgcatttaaatataaaattttattttatttgggacggagtctggctctgtcgcccaggctggagtgcagtggcgcaatctcggctcactgccagctccgcctcctgggttcacgccattctcctgcctcagcctcccaagtagctgggattacaggcgcccgccactacgcccagctaattttttgtatttttagtagagaagggatttcaccatgttagccaggatggtctcgatctcctgacctcgtaatccgcccgcctcggcctcccaaagtgctgggattacaggcgtgagccaccatgcccggcttaaatataaaattttaattaggccaggcaaggtggctcacacctgtaatcccagcactttgggaggcccaggcaggcagatcacctgaggtcaggagttcgagaccagcctggccaacatggcaaaacccggtctctactaaaaatacaaaaattaaccaggcatgggtgcctgtaatcctagctactcgaaaggctgaggcaggagaatggcttgaacccaggaggtggaggttgcagtgagccaagatcacgccattgtactgcagcctgagtgacaagagtgaaaaaaaaaaaaaaaaaagataaagtggaaaaggacacccccaaggatataaaacaagttcaaattggtagatgggtcacagcagatacgcctaaaatactaaaaagattgggggggggggaagaaatggtgtacttgaatggatacaaaaattctccaaagggggtgaattttaggcaaactggtcataagacaaattgaaaagccaggcttggtggctcacgcctgtaatcccagaactttgggaagttgaggaaggaggattgcttgaggccaggtgttcgagaccagcccgggcagcgtaacaagatctcatttctacaaaaaatttaaaaattaggcaggcaccatggcttgcacctgtagtcccagctactcaggatgctgaggcgggaggatcccttgaacctaggagtttgaggttgcagtgagctgtgatggcaccactgcattccagcctggccggcagagccaggccctgtctctaaaaagaaagaaattgaaagctgtttgcctcctgcccagcagcgagagaagacgggtggctcctgtcagttctctcccatctggaagaggcccacaatgtcaaggaaggcctggtggagaggtcactgcgtcctggagtgaggctggtcgcagggaggccttcacagaggctgagcctaaagccaggcttttttacctcaggccaggcccccggacactgccctctgcccactttcgcatttcctttttttttttttttttcaaattgttcccctttccccagccctctctccagagaagtggtccagtgctcggtgaccacctccccacactccaccggcccaattacaagtggcgattttctgtttattgctcaaaaacaagaattcagaagcaaaggtggagagactgtgggttggggagatggcaggaagggggcaaggccttgtcccagctctcccctttgtccttcttctgaccctcctggccggagtcaggcctagggccagggcatctgggaggggggcaccttcgtggccaagggaacagtagagctatcgggggcagtccttgaggggtgccctgggcaggaggggctgcaagatttgcagggaggcagagttcccctcccagaatccaaaagccggtagggcggggggcaggcccctcgtttggcaactgagaagaggcggctttgggcggcaggatgctggtttatttactgtaggatctccagggccatcaaagccccctcgtgggatagggagactatttacacagccagggaggagggcagccaggaggcagagaccgggtcccgtatttccctctgcccgaatgaggaggggaggggcgtcctgggtcctgcagctgtagtcttggggttcagatggaaacttcatactcccgcgtatcctgaagacagagagatcaggtcagttgttggagtctgataggggtggaagaggcagccgaatgggaggaggggcaacgatcctgggttttaaagtaacattgacctctaggggctggggggccagtgaatgtgtttggttcatcctacggtgtcgtaaaatgacacaaaaatctgaatttctggcttgtcttgaataattggaagatctgccaattgtgcctcagtttcgactatggggtagagccgtattcttgagatggggcacaagtcctccacttagccacagtcctcaccactccctattgtatacacatggcttgctatgctcattgacatggcctctgggggcagctgagtttgaaattcccaagacagagattccagagaccttgcgagaaggttatggagtcctgggagagccaagtggtggctcttcaggggcaggcaaggtgcttaccccagcttcatacagcgggttgctgaagtccgactccacggtgatggggctgtaggagtgggagcccgagaagccgaaaagggactttccctgaagcctgggaaagggagaggacagaggagcttatcaacaggtaagcccctgagctcccctgacccaggctccagtgccaggctcgcaagacgtctgccctggccggcagtccccaagcaggctacttacttggtgtagtagatgtaaacgccactgccgaggacaatgaccaagcctagaggcagcaggatggccagggccaggttccccccttccagctgccgtgatggatctgtggtctgggtcactacaggaggaggagaggccggtgagctgtggctgggcccggtcctgggctctcccagcctcctgccctgggcctcaaaccctgggcttcatccctccaaggcctggcctcctgccccagcctctgccttgccctcccaacctggccagcctgggtctccacctgtgctctcactgaccttccagttttcggttgtccaggagctcctcataggcaactgcagggagaggagggggaggggatggggtctgagccagggaggggaggaggctgggaggggccgggagcccggtggggctgggctggacagcctggttctctctgccctctgctcaacctcaactttctccctttgtggggaagagagaggagtgaccagcacagggcctttgtcctctttctccagacccctaaaaagtcagggttcctggacagtctgagccaaactagaacttgtcagcgatagggaaactgaggcctattcagagcaagggacttccaagccaaggccccctctactacacccctgagccaatcccatgacctcacacgacccagggcttctggacacacccgtgaggacacgaggccacaggaggagaaccgggagctctgtggggtcgcccattggtctcaaatgtgctacctgactctcccagccctgtcacttcccggacactggtgtgcccctcctgccctgtctggccaggcacctttgcagagtgggggctggctggtccactgggaggggtggccgggcacacaggtgatggtgacctcgccgataagctcaaagccctcatagcagaagaagcgcagagactcgcccgcctggtagtggtgcttgtacagcgtctggtagccattctcgggaacccccgggttcaggcacggctcgtacttcactgcggggagcatgccagtcacgtgccagctgcactactgtgcacggggcagacgggctctcccagggctacccagccaccctcccagggtgtgccccagactcacaggcgcatttggggaccctatcgctccacttgggtgtgcctgtgtcccggctgtagcaggtgagcatggctgccccctcgaggctgtaccctggcaggcagcggtactggacgtgggagccaacggggaagccggcgtccgaggcggtgcggtgcccgttggcaatctcgccagggtcagcacaagtcatgactggtggcagaagaacaaggtcagggggagcgagggccttcaaagatcagcctgggcaacacagagagaccccatctctacaaaaaattgaaaaattagccaggagtggtggcgcactcctgtggttccagctactcaggagttggaggcgggatgatcgctcgaacccagcaggtcgaggctgcagtgaatggtgaccacgctactgcactccagcctgggtgacagagtgagacccagtctaaaaaaaataaaagaaaatctcccagaagcttagggctgggagaggcctgagcctcaggctgtttcctctgaacacctctgcacacacacgcacttcccaccaattcctcagaaggaagagagcatgaattggaaaaacttaaaatgcagtgcatctattttcaggccagaatgacaggcttaatttttttcaaaattcaacgtatgttatatttcaggcttcgtttagtaaacagtttgcttggggaaaccccaagcccctatcctggggtgaaattcaaaatatttaaccaccataccagagcatactagccaaatcccagcagggtgagcccaacatggcttgtagtctgtggaacagcagctgccctctttagagggggcccagctctcctgtccccagtattctcattatgcccagcccagttcactcacatacactccctgccttcaggcgtttgagtttacaaccctgttgtgaaggaatcataatcatagccatttcttgtatataagcctgagctacgtaccctgctaaatgttttacaaacaaatataattctttgtgtgtgtgcttgttttttttttttttttttttttttttttttttttttttgagatgggagtctcgctctgtcgcccaggctggagtgcagtggcgcatctcggctcactgcaacctctgccttctggactcaagagattctcctgcctcagcctcccgagtagctgcgattacaggcattcgctaccatgcccagctaatttttgtatttttagtatagacagggtttcgccatgttggccaggctggtctcgaactcctgacctcaggtgatccacccacctcagcctccaccagtgctgggattacaggtgtgagccaccacggctggccccaaatataattctttgttttggagacgagaacttgctctgtcactcaagctggaatgcagtggtgagatcacggctcactgcagcctcaaactcctgggcttaagcaattctcgcaccacagccttctgagtagctgggactacaggcatataccaccatgcctggctatattttttattatttgtagagacagggtctcactatgttgcccaggctgttctcaatctcctgggctcaagtgatcctcccaccttggccttccaaagcactgcaatttcagatgtgagccaccacacctggcacaaacataatatttaatcctgattatcctgagaggccaatgtcactgtcatctcccttggagcccagggctcagggcggtcaaaggacttggcccatggtcattcagccagggagtggcagagccggaatctgcccagggtcacagccatggagcactggacagggactcagatatgtgggtcctggcacaccttcaggctcaatctgctgccttgggcaggttccctcctgagcccgaggcagcggggccagccgaactctcagccccatccaggcctgatatcctgtgaatccttccaggggcgggaagctttgtccagcccaaatctggctacctgaagcttctccccttggtcccaccattgcttccagatgccacatggaactacagccccatgtccttggggctggcttcctaaaatttggagaaagtaaccagctgccattcctttctgctcttcaattttctttttctttctttctttctttcttttttttttttttgagatggagtatcactcccgtggcgcaggatggaatgcaatggcacaatctcagcttactgcaacctccacctcccaggttcaagcgattctccttcctcagcctcctgagtatctgggattacaggcgtatgccaccatgcccagatagttttttatttttagtagagacggggtttcaccatgttggccaggctggtctcgaactccagacctcaggtgatccaccgcacctggccctttctgctcttctaaaagatacacactcccagctcctttaaatgtcacctcctctgtgaaatctcctgccccagccctgagaaaattagcccactgctctccccacagcacttcgccacgcccagggcagcatgcgccctgtgaactttccatctgctcttcacaacctcagtcctacttcgccgatggggaaaccaagcctcagaaatgctaagtgcctcgcccaaagtcacccagtgatcaccaccctgcgtatccctcccagactgcgagctccataagagtatggaggggcttgaacccccttcgcctaaccccaacccagcacggggcttcaatgatggcattcaaataaaccaagtgctctgacaagccttggtcctagcaaagtggctccctacaatttcaactgataggactgcgggattggggcggggcgtaggacaggaaggtggagccaagtgtggacccggggagcccagtgggaacctggtcggagcccttttaggggccaaactcagatgccgcagaggaggggtcaggaggggacggggcggggccgtgagacgaggaaacagggaccgagcccaggtcggtgcaagaaagagggatgcagcccggagaagatgagagggagacccagaggggacagtttcggggaaccgggcggaggagtgagaactaaagggcatgggggcaggccttgaagaagatccaggaaggaccccgagcgaagggatggaacccagaaagcacgggggtcgggacaggacaggccgacgacggggcccacagggaaggggcggggccgaggggacgcgggcggggccggctcactcttttggcaggcgggcggcgcggcgctccaagacaggtcccactggcaagtgagaatgtcggagcctagcagctcgtagccaggctcgcactggtaggtgagcaccgtgccccggatcaggtccccgtgggatgccgttctccagccccactccggaggtggcagctcggggcacgtgtcgttcctcgggacctctgcaggggagggaaggcgagtttggaggctgcgttttaactgcgggctcccttccagcctcggaggctttgctctgtgccccctcccgggatctgtctctctctctctctcttagagacagggtttcctgtcgcccaggctggagtacagtggtacaagcatagctcactgcagcctcaacctcctggcttcaaacgatcctcccgcctcggcctcccaaggccccgggataacaggcgtgagccaccacgaccggccacctcccgggatctctggcctgcccgacccctgcccatcccgggactctatccctcagtacctttgaagtgcaatacgaagccctggcccaggcctggatttgggggcccgggcggtgcctgaaactgcagtgtgaggtcgggcccagaggagagaaggcggcggcgcggctgaggtccccgcagctgggccaagactcgggcgctgggaccgtccccgtcgaacagcgtcagcatgtccccttcccgcacattcaatctgcagggggtgagaccaggcaatggggcggggctgcgactggcccctcccatccagctctgccccatcctcaactctgctcattggtagcccctcctactctccagccccgcccatattctcctatcccaggtctggcgccgcctccgttttgaccaaccatggtttctcctatgctagtgcctcagggttcccctattctatggctcctcccatgtcctactacccaatccctaagcttgcacattactaactccgcccactgtccactccctcctccatcaccatgagatccacagcctagcccaactccagctctggccaatcacagaccaaattcgctaacgccctacacaactctaggccccgcctgagtacctgctttgaagccacgcccacttcagcttctgtgccatctcatgacactctcataccaattcagctcactggattctccccagacctccccaacttgctggtgttaacgcaacagtttgggtctgtgtccgtggaaatagctccaggggaagcctcagaaacctccaaagagtgagaggcaccaggccagagccccttgttcacagtggcccctaaggaaggctgcattgccctatttatttgtccgaggttgcctggctaatatgtgatttgagcccagctctctcacgtctatcctgtacccttagtgcaccagcctatccaccgaattctggatagatacgcaagagccagacaggctcagaatgcaggctactgcattggcataccacactttgctgagcctacacccgtcgcaccctctgcaggacccaaacatacatctcaacttggagcaagatgcgcttctcttcctggacgtgcacgccccacacgcagtcttggcccgggctatagctctggggccagtcgggagagaggaccacgccagctggttccgacagctcccctccacacatggctagggaaaaaggggtgtcaggttcaggacccaggtgggcatgctgtcttcatttctccacagtcctcaccactcgtgatgcgtgcaccacatcacctcgcttgtttcctattacctatgatccacctgtttcttttattcttttattttatttatttatttatttttaaattttttttgagacggagtctctctgtcgcccaggctggagtgcagtggtgcgatcttggttcactgcaagctctgcctccctggttcacgccattctcctgcctcagcctcccgagtagctgggactacaggcgccgccaccacaccctatttttttttcttttttctttttttttttttttgtatttttagtagagacggggttttacggtgttagccagaatggtctcgatctcctgacctcgtgatctgcccgccttggcctcccaaagtgctgggattacaggcgtgagccaccaggtccagcccctatttttatttttttagacagagtctcactctgtcgcccaggctggagtgcagtggcgcaatcccggctcactgcaatctccacctcgcagactcaagcgattctcgtgcctcagcctcccaagtagctgggattacaggcacgcactaccatgcccggctaatttttgtatttttagtagagacggggtttcactctattgaccaggctggtctccaactcctgacctcaggtgatccgcctgcctgagcctcccagagtgttgggattacaggcgtgagacactgctcccggctttatccacctgtttcttttttctttctttctttcttttttgagacggagtttcacacttcttgcccaggctggagtgcagtgctgcgatctcggctcaccgcaacctccgcctcccgggttcaagcgattctcctgcctcagcctcctgagtagctgggattacaggcatgcatcaccatgcccagctaattttgtattttaagtagagacagggtttctccatgttgatcaggctggtctcgaactcccgacctcaggtgatccgcccgcctcagcctcccatagtgctggtattacaggcgtgagccaccgtgcccagccatgatctacctgtttcttgccgcatctaggtcctgttgtgttcaatatccagtcctgctcttaacaaaccctgcccactctccagcctgcccaatctgtgacttaacccaacagcagttctcgctcttgaagacatttgggtttgtgacccctgcattcagtaacaagcccagcagttattcagctaagaaaacagcctctgaagggacagggatttacccaaggcttgggtggatgaagtctggatgtgcagccttcctttctgaacggccttgctgggatccccagttcagggggcaacgtggactgaaggacatgcctgcgacaaggaaggctcacctttgcaggccggctctgtgtcgttccagtggggttctgtgggatccacacattcgatggcattggggggcccagggggctccagggcatatcctgggaggcacgagaaggttgccagtgcccctgggcgatactcagggtccgtggtagtgacatttccatgtgccaggaagggggcgaagcagcgatcctcctcaaaggctgggaaggagtcagtcataacaattaagcattaggacaggcctcaagggatcttaaattggggatgtgggctgaattggggtgttctttggccactcactgggcttttttttttttttaaacagtcttgtgctgtcgcccaggctggagtgcagtggtacaaccttggctcactgcagcctctgacttccaggttcaagcaattctcatgcctcagcctcccaggtagctgggattgcaggcgtgcaccaccatgcccagctattttttttttttttgagatggaatttcacacttgttgcccaggctggagtgcaatggcacaatcttggctcaccgcaacctccgcctcctgggttcaagcgattctcctgcctcctgagtagctgggattataggcatgtgctactacgcctggctaattttttgtatttttagtagagacggggtttctccaggttgatcaggctggtctcaaactcccgacctcaggtgatctgcctgcctcggcctcccaaagtgctgggattacaggcatgagccaccgtgcctggccaatttttgtattcttagtagagacaggggtttcaccatgtcggctaggctggtcttgaactcctggcctcgagtgatctgcctgcctcagcctcccaaaatgctgggattacagacatgagtcactgcgcccagcctgggtttttttttaatttttttagagacagggtctcactctgttgcccaggctggagtgcagtggtgtgatcacagctcattgcagcctagatcttctaggctcaagtgatcctcccacctcagcctctctggtagctgggactacaagcatgcacaccccacccagcagctcattttctgattttttttttttttctgtagagatggagtttcaccatgttacttaggctggtctcgaactcctgacctcaggtgatccgctggcctcggcctcccaaagtgctgggattacaggtatgagccattgccctggcgttggtgggtttttaaaaactgaatgccactgggtttagcattcactctccagactgtcaaaaaaagttctaacactcctcattcacatatttatattgcctccctggcctctggagggaagccactgagctagccaaatcccagccaccattctacagagcggaggtccatagaccaaaaagccacttgctcaaggtcacacaaaagacaatggcaaaagcaggtctcaaacccagatggtttgattcccagccacagatacttggctctggaaacagcagagatagcgggtaaggggaggggtgccttcagagaactggctggtgtaggtgtattgtctcctcagaaataacagttggattctgatcatccatgctgttgctgaaacccaaaatttcagctaatgcaaaaactactcagtttttacttcaagtcagcaaaagtgaacatttgtagagcatttgagtttctgcccacctgatcggatcttagctgcaaaactccctgtaagttaagatttaggtgcctatgataccaatgaggaattcttttttttttttttttttttttttgggatggagtttcgctcttgttgcccaggctggagtgcaatggtgtgatctcggctcactgcaacctctgcctcccaggttcaagtgattctcctgcctcagcctcccgagtagctgggattacaggcacccacaaccacccccggctaatttttgtatttttttagtagagatggggttttaccatgttggccaggctggtctcgaacacctgacctcaggtgatccacccgcctcagcctcccaaagtgctgggattataggcgtgagccaccatacccggccttttttttttttttttgagatttttaattttattttaatattttatttttttattttttgagactgagtctcgctctgtcgcccaggctggagtgcagtggcatgatctcacttcactgcaaactcggcttcccaggttcaagccattctcatgtctcagcctcctgagtagctgggattacaggcacgtactaccacacctggctaatttctgtgtttttagtagaaatggggctttgccatgttgcctaggctggtttcaaactcctgggctcaagtgatccacctgcctcagcctcccaaaatgcggagattacaggcatgagccactgtgcccgggttattttatttatttttaaaaatgaggccagatgcagtggctcacacctgtaatccccccactttgggaggctgaggcaggtgaatcacctgaggtcaggagtttgagaccagcctgaccaccatggtgaaactccgtctctactaaaaacacaaaaattagctgggcgtggtggtacatgcctgtaatcccagctactcagaaggctgaggcaggagaaccacttgaacccggaaggcggaggttgcagtgagccgagattgcgccattgcactccagcctgggtgacaagagcgaaactccatctcaaaaaaaaaaaaaaaaggaaaaaaatgagacagggccttgctctgtcacctaggctggagcgtgcaatggtgggatcacaactcacagcagccttgacctcctgagctcaagcgatcctcctgcctcagcctcccaagcagctgggaccacaagtgtgcaccaccacacctggctaattttttgttttgttttgttttgtagagacaaaggtcttgctatgttgcccaggctggtctccaactcccaggctcaagtgatcctcccatcttaacctcccaaagtgctgggattacaggcgttagccattgtgcctggccacagtgaagaatcttaaactcatagaatagcagtggcctacaactctggagtcaggactcacaacttgctattttcggtaaaagatctgtgctgtttgcactttaacactcccagaatctatcccgcaattcatttttgcagatccactgttctatttcactgttacttaacctgcaaggtatcatgtccaaatcctacccatccatcacagccgagtgccaattccatttctcccatgattcatatcaaacactagaccctcctatctctaagcatttcatctttttggtctctctcttgctactgtttatacaactcctctgtttcagccacaatgaaattctgtttcccagacataccaggcatttccctacttgctgtttctcaaagttcctctctttccttttcttttcttttcttctttttttttgacagggtcttgctctgttgcccaggctggagcacagtggtgcaatcatagctcactgcaacctctggggttcaagtggggttcaagtgatcctcccacctcaaccttccatgtagctgggactagaggtgtgtgccaccacacctggataattattacttttttttaatttgtagacacaggatctcactatgttgctcagactggttctcaaactcctggcctcaaacaatcatcccaccttggcctcccaaagtactgggattagagacacgagtcaccacaactggcctcaatcttcctcttttaaaatatcctctgttggctgggcagggtggctcacgcctgtaatcctagcactttgagaggccgaggtgggaggatcacttcagctcagtagttggagaccagcctgggcaacatagtgagatgctgtctctacaaaaaatgtaaaaattacccaggcatggtgccgaacgcttgtggtcccagctactagggaggctgaggcaggaggatcacttgagcccaggaggttgaggttgcagtgaaccatgatcgggccaccgcactacggcctgggcgacaaagcaagacctatttcaataataataataataataataaaataccctctatcctttaaggccaaggtgaaatgcctcttcctccatgatcacttccttgtttctaccccttcacattcattcctcttcttctggtaacggcatcccaattttaattttgggacgcaggccttccccactcccagtccactaggttaagttggagcccaccagggaaggccacgtgaggcagattagccaatcccaatactcccttctcctagctcagtgattggctcaggctaaggccaaccaggatcttagtcaggtcaatgaacgcctctcctggcatttttgctgagctctcaggaaatatatgagtgttctctctgatgaggttactcggttggtggtatgggctggaggaggtggcttacacctgtaatcctggcactttgggagtcccacatgggcgaatcacttgagcccaggagttcaagaccagcctgggcaacatggtgaaaccccgtctctactaaaaacccaaaaattagctgggcgtggtgatgcatgcctgtaatcccagctactcgggaggctaaggaatgagaatcgcttgaacctggaggaggggggctgcagtgagctgagatcgcgccactgcactccagcctgggcgacagagaggaactctgtctcaaaataaataaataaataaaaataaataaaaactaaaaactgtcaggcgcagtggctcacgcctgtaatcccaacactttgggaggcggaggcgggcagatcacctgagttcgggagttccagaccagcctgaccaacgtggagaaaccccatttttactaaaaatacaaaattagctgggcatggtggcgcatgcctgtaatcccagctactcgggaggctgaggcaggaaaatcgcttgaacccgggaggcagaggttgcggtgagccgagatcatgacattgcaccccagcctgggcaacaagagcaaaactccgtctcaaaataaataaaggccgggcgcggtggctcactcctgtaatcccagcactttgggcggccgaggcaggcggatcacaaggtcaggagatcgagtccatcttggctaacacggtgaaaccccgtctctactaaaaatacaaaaaaattagtcgggcgcggtggcgggtgcctgtagccccagctactcgggaggctgaggcaggagaatggcgtgaacccggaaggcggagcttgcagtgagccaagatggcgccactgcattccagcctgggtgacagagcgagactcgtctcaaaaaataaataaataaataaataaaataaaaattaagttggtggtatgtaagtcggcagctatgtccatcacacagggaaagtgcctaaggatgaagccagcacagaggaaagaaccgagatactgagataactggtctctgggctatgtacctggatccagacattcatgaagcttaaacagagaaggctgcctgggggaaggagaaggggtccctagaagagatccttgcagttttggggcagggaagcgagtcacgtttcaaggaacccagcacggagatgaacaggcatagagtttgtgcttccgactatgcttggtgtcaggaagaggggaaggtgtggcggttggggtcctgtgggggagtgggtcacttaccttcaaatcgaaggcttaacagcaggggattggcaggtgtctctgacagcagctccacgtagagggactgggcgtcactgatgagaccccgctcggggacatcgtccatgtccgaatcatagatcacgggggatagggggctgccccctgagcgcaccatcagcctgggatggacagaaacgtgaccaggagctcaatctccctcacaagctgcctcaccccttgcctgctttcctaacttatttttatagctgttatcatcacacataactatatgccacgcactcttctaagcccttacacattctatctcatttaattttcacaagaactcttgagtcagacactattattatcctttattttatagatgaggatattagggcatagaaagatcaagtaacctgtccaaggtcacagagcaagtagtggcagggctgagataccaagttgctaggtaaaggatgataatgatgatgaagatagcagatgcttgaccaggcatggtggctcagctcacacctgtcatcccagcactttgggaagccaagacgggtggatcacctgaagtcaaggagttcaagaccaggctggccaacatggtaaaaccccatgtttactaaaaatacaaaaattagccaggcatggtggtgcatgcctataatcccagctactcaggaggctgaggcaggagaattgcttgcatctgggaggtggaggttgcagtgagctgaatccgtgccactgcactccagcctgggtgacagagcgaaagtctgtctccaaaaataaataaatagataaataaggccaggtgcagtggttcatgcctgtaatcctagcactttgggaggctgaggtgggtggatcacgaggtcaggagatcgagaccatcctggctaacacggtgaaaccccaactctactaaaaaaaaaagtacaaaaaattagccggacgtggtggcacacgcttgtagtcccagctactcgggaggctaaggcaggagaatagcttgagcctgggagacagaggttgtagtgagccgagatcgcaccactgcactccagcctgggcgacagggtgagactccatcttaaaaaaaaaaaaaaaagaggatagcagacacttttatagtgcttattgtcccaggtgccattctaaggactttatataatttcagcacttatcctcacagaaacctgaagagggaagtattgttatctccattctacagatgaggaaactgaggcacaaagaagttaagtgatttgtctaaggtttcacagctacacttcctaagaaagtcttaggactggctgggtgtggtggctcacgcctataattccagcactttgggaggccaaggtgggcagatcacctgaggttgggagtttgagaccagcctgaccaacatggagaaactccatctctactaaaaatgcaaaattagctgggcatggtggtgcatgcctgtaatcccaactaatcaggaggctgaggcaggagaatcacttgaacccgggaggcagaggttgcggtaagccaagactgcggcactgcactccagcctgggcaacaagagtgaaactctgtctcaaaaaaagaaaaaaaaaaaaaaaaaggcttaggactaagctgtgatgcatatctcaaccaggatccaccccagctgtgtccaagtccccacttagcctccctacttccctgaggtggggacttctttttttttttttgagacggagtctcattctgtctcccaggatggagtgcagtggtgcgatcttggctcactgcaagctctgcctcccgggttcacgccattctcctgcctcagcctcccgagtagctgggactacaggtgcccaccaccatgcccggctaattttttttttttttttttgtatttttagtagagatggggtttcaccgtgttagccaggatggactcgatctcctgaccttgtgatccgcctgcttcggcctcccaaagtactgggattacaggcatgagccaccatgcccggccaaggtggggacttctgacccaagacccagacccttaccggtcattgtcctcatccagcgagaccctttcaaagtgcaggtgcagccggcgcccctcagctgcttcaatgacccaacggcaggtgaggttgggccctacggctcccccaggctctggggacacgatgcggcccagggtggcattgtggatggtgccaccacaggatgctgtgggcagaggaggggtacgttaaggccagcctgaggtgaactgtccttctcctcggggcctcggcccgttttcagaactgttgcattcacacatttggctgggacccggcccagggctggcctctgtcccatggagtcactccagaggatgggaccttctccaggcatgagccaggaaagaaaccagccccggtacgggagaaccccaggattgacacctcctaggatggagacaccactaaaatgaagactctccaactgcggatactctaggatggggagttacaaggatccctaaaattcaaagcctcagctgggaaatcttcaggacaggactttcagagtgaagacaccacgggatgggaatcccagtaagaggctctctaggatagaagccctctggacatgaaccctaaaaatggcttcctctaggatgaggacgctaccccagaagggacctccagaatggtgactcccaaaataaaatctccagtgggacaccccgagatggagaccacccaaggatggagaaaccccaaggagagagaccctccgcacaaagagctctggctgcagaccccaggatggggactcctcagggtaaacaccccttcagaatgggttttccccaaaggtggacacctggacacccccgagataggaccctcccaatggggttcccagaacagatgccccacccactgtggcaggagactcacccatgcagctgggggtttcaccgttccaggatggccgggtgccattgaggcagatgagggtctcctctccctgcagctggtagcccgaatcacagtgaaaggtggcagtgcccccagggtgcaggtccgtcacactcacgtccccatgggccggccggggagggaagccacagctcaggaggtaggctgcaccagacagacagcgggtagcagggctcactttcccatgccaccctctcatactgatcccccagcacttcccccctctcctttcaggccaaccttccaggggcacacactggctccatactggcgtacataccgagaaataagagctcctcacacaggcaccttgcctcgcgaacaggaaactccaacaccccttatctcccccactcattgtaattcaccctcgttggcccccattttatagatgaggtatctgaggttcaaacaagttattctggaccccgctactcatttgttgtgtgacttcaggcaaatcaatgaactactctgaacttcatccagctgtaataacagtatttgcagagcttgttcagctcccaaagtgagtccacacagagattttgaggtcagcagacaaagattatgtgacctggctaggcatgctggctcacgcctgtaatcccagcacttttggaggccgaggcaggtggatcacgaagtcaggagttcgagaccagcctggccaacatggtaaaaccccgtctctaaaaaatacgaaaattagccaggcgtggtggtgggtgcctgtaatcccagctacttggtaggctgaggcaggagaatcacttgaacccaggaggcagaggttgcagtgagccgagatcgtcccattgcactccagcctgggcgacaagagcaaaactctgtctcaaaaaaaaaaagattatgtgacctgttttgcaggtgtgaacactgaggctccaagttattaaatgtctcttttgatttttcttccctccacacacacagcctttcttccaccaaggtgccctgtggtataccctcagctcctcagcttccatccagaagaaccacttgaaacttctttttttttttttttttttttttttttttttgagatagggtctcactgtgttgcccaggctggagtgcagtggtgtgatcatagctcactggaaccttgaactcctggcctcaagcaatcctcctgacccagcctcccaagtagctgggactacaggtttgtgccaccatgccccgctaatttttaaattttttgtagagatgacatctcagtatgttgcccaggctggtcttgaactcctggcctcaagcaaacatgaaacttgttgaggaaatttgactattttgtctttttgtttttgtttttgtttttgaggagaagtctcactctgttgcccaggctggagtgcattggcgcaatctcggctcactgcaacctccgtctcccgggttcaagcggttctcctgcctcagcctcccaagtagctgggattacaggtgtgtgcgaccatgcctagctaatttttgtatttttagtagagatgggattttaccatgttggccagggtggtctcgaactcctgatctcttcagacctcctgacttcactttcactgggggattcatttacaggccactgagtattaagatctttaaagacaaaatagtctttaaaggcacagtggctcacgcctgtaatcctggcactttgggaggctgaggcgggcggatcacctgaggtcaggaaaaagacccaggccttgtcctcaggagtccattgtctactgagatgaacataagaacaaccttctagaacaaagtggtttcaataaatggtagctttgggaatggctgcccatgcccaacagaatcaagtctgaatgctttagtttgacattcaagccccttccatagttaaatgcagcccagcacattccaggttcagggttgatctcccaagaccgatatagcctacacaacacagttttgtgactccttaattttccacctccatattttcgcttgtgctctccccctactttctcatcttttaagagatcagactggggggcttatgtaccacctcttccaggaagccttcctgactctacatctctccaacagttacttgttctcttacctgtacacagtcctgcatgcatgattttgtcatcacattaaccattgtctttttttttttttttttttttttttgagagggtctcactctgtcacccagtctggagtgcagtggcttgatctcagctcattgcaacttttacctcccgggttcaagtaattctcctccctcagcctcccaagtagctgggattataggcgtgtgccacgactcctggctaattttggtatttttattattatttattttattattattattttttgagacggagtattgctctgtcacccaggctggagtgcagtgacacgatcttggctcactgcaacctccgtctcccaggttcaagcaattctccggcctcagcctcctgagtagctgggattacaggcatgtgccaccatgcccagctaatttctgtatttttagtagagacggtgtttcaccatgttggtcaggctggtctcgaactcctgacctcgtgatctgcccgcctcggcctcccaaagtgctgtgattacaggcgtgaaccactgtgctggtattttcagtacagacagtgtttcactatgttggccaggctggtcttgaactcctgacctcaggtgatccacctaccttggcctcccaaagtgctgggattacaggcgtgagccaccatacctggcctaaccactgtctacactggcccaagccttatttattttgtgtcctaaaaggctagtctatgaggtcaggagttccagaccagcctggccaatatggtgaaaccctgtctctaataaaaatacaaaaaattagctgggcatggtggcacacgcctataatcccagctactcaggaggctgagacaggagaatcgcttgaaccaagggggcggaggttgcagggagctgagattgtgccattgcactccagcctgggcagcagagtgagactccgtctcaaaaaaaaaaaagggctagcctggctgatcaatgggtgcagccaagaggcagcatggatcggtgcaaagaccactggatttgtcatcaggcagacctgagttccagttctagctccagaacttactaactacatgcctttgagcaggtgacttcatctctaggggcctctcacctattaacggcaataataattcctatcagggaagattggcctgaaaattaaataaaagaaacacgcaaagcacctggcacatagaagctgctgagaaaacgttaatcacccacccctcagcctcaattaatgaatgactgggagccagggactcggggatctgttgtctggctgcaataaacgtgcagatggttgagcaatctacataacctttgagtcttttccttcctttgagagatagaactgacaatggccactctcagggtttctgtgagaagcaaatgaaactaaggttggtgaaagggctttgtaatgggaaagtttgctgaacttggggtgaggggtgaaggagactttggcttttcagagaaactaatgaggccactctggaccagaggccccagctagtgcaggttgggaagggctgaaacagggccttggtcccaaaggtacccagtgcagctgcgaagcagggaagactgagcaatgaaggccaatttgtgcaatagtcctgcttccccaaatgttccacttagcctaaggagtcctattttcagtgccctggggaagtggctgcttaaaggagccagtggggagccatatcttcagatttcacaatatctgaaatccagcacttggcccaggccctccaggaatgctcttgctccccaataaccaggtccctactgccaaatacacgtcccccagcttgctggcccccgatgaataggcacctttgctatgcacacatgagcccctaaggcaggtcctgagcagaggcctcaaaagaggctggagaggacatgagaataggattcagggtgtaccctgcatgaggcacacaaggcatctgcggtcagcagagctttcaaggagggcagagtgcgtgacaccagccaaggccatgcggtgatgtgaagggggcattggcccgacacacagttctctctgtctccatgaagcataggaagacagtggggtctggaacagggcactggctgggcccctttcctcatgcacacatgtctgctagaacacacccttgtactgtgggaaggttcccgcacacacaggtaagcatggatgtacacacatgtgcaggtcatctgtcataggtcctaacaaatgcagtcgtgcgtgaatacagcccccctttcctgcccccagaagtcagaaggatctttaaattgcaaatctgaggctttcactttcctgcttaaaacatttcaggccaggcaccatggctcacgcctgtaatctcagcactttgggaggtcaaggcaggaggatttcctgaggtcgggagttcgagaccagcctgaccaacatggagaaaccccgtctctactaaaaatacaaagttagccgggagtggtggggcatgcttgtaatcccagctactcaggaggctgaggcaggagaatcgcttgaacccgggaggcagaggctgcggtgagccaagattgcgccattgcattccagcctggccaacaagagcaaaactccatctcaaataaataaataaataaataaataaaattcaaattaggaggcctggcgtggtggctcatgcctgtaatcccagcactttgggaggccaaggcgggtggatcacttgaggtcaggagttcgagaccagcctggccaacatggtgaaaccccatctctactaaaaatacaaaaattagccaggcgtagtggcaggtgcctgtaatcccagatactggggaggctgagacaggagaatcatctgaagctaggaggcagaggttgcagtgagctgaggtcatcaccactgcactccagcctgggcaacaaagtgagactctgtctcaaaaaaaaaaaaaaaaaaattcaaatatctgcctgtcacacctgcaggttgaagtagtctggactgcttactgaagcagataaggctctttatggtctgaatctgacctgcctcccagcctggtctctggcccatttccccttcacccgcttctgtgctttgaaagtaatagcagtgactgacagttttgagctctcactgtgtaccacacgctgtttgtgtttttgtttgtttgtttttgagacagagtttcacttttgtcacctagcctggagtacaatggcgcaatctcagctcaatgcaacctccgcctcctgggttcaaacaattctcttgcctcagcctcccaagtaactgggattacaggtgcttgccaccatgcctggctaatttttgtaattttagtagagatggggtttcaccatgttggccaggcaggtcttgaactcctgacctcaggtgatccaccagccttggcctcccaaagtgctgagattataggcgtgagccaccacgccaggccacacactgttttaaacacttgacatgtattaattcatttgatcttccccataatactaagtattgtgatccctatttttcagatgagatcatgaggcacagaaaagttaagtaacttgtcccaggtcacacagctaggacaattctatcttccatgctgaattccttcacctcatctgggggtcatgtcttctctctctgggtcttggagtgtgctttttcatccacttagccatctgcctccctccttctctccctccctcccaccctttccctggcgaatttatccttcaggtctcagcttagtcatcatctcctccaagaagatgtccccatattccttgggagaaatttaggtcccttggctatgtgctgcccccgctggtgtttctgccatcatattccttatctccttgaattataaccatcctgattactcatctgtcttcctacctagattctgagctcgttgaagccagatttacacctggtttgttcattcctccttcaaggctaacacagggcctggtatgaagcaagcacttgataaacatttgttggattcaatggatgaattgtccctcggatgtgtgcacagatctgtgagtgtgtgagataagtatgcatgggtctcctctgagggccctgccccccagggtcgcagtcaggaggaaaagcccccttcggcaccctgtgcttcgatggttcttaaagatgtcccctctataggccgggcacagtggctcttgcctgtaatcccagcactttgggaggctgaggcaggtggatcacaaagtcaggagatcgagaccatcctggctaacgcggtgaaatcccatctctactaaaaatacaaaaaattagctgggcatggtggcgggcgtctgtagtcccagctacttgagaggctgaggcaggagaatggcgtgaacctgggaggcagagcttgcagtgagctgagatcacgccactgacctccagtctgggcgacagagcaagactctgtctcaaaaaaaaaaaaaaaaaaaaagatgtccagtgtatgcagtatggcccctgcccttccagcagcaccctcaaactcctcaccctgatagtggatcctgaagccaccgccccttgggacccgtgggctctggaagtgcagaagcagccggttggttgggctccgaaggacttgtccttctccaagcatggatgagttggccaggagtcggggggccaggcctggggatcccccaccagccagcaccaggagctcctcttcctgtgacaggttcagcgtctgcacctagagaagccagacacagacccgccagggcaagtcagccaggtgtttgacttccaaagcccctgtcctgtgcctttgccctgtgtgtagcagcccaaaaggcaccacgctgctgcccaagttgtagaaatctagaagagtttttgaggtcacctgagtcatcagacaggttctttggctcccaggccaaacccgtgcacacccacagcccagaggaaaaggcttggaagctgcacagtcacatgctttggtccagttacctggatctcaatgccgtagccagggtagacatggatgctgtaagtgcagtccaggagccccagggtgcggctgacggggctccccagatctggagactccacatacccttcgccctcggagatgttgttattacacagaactgaggagatacaaatggctgggatggaaggaatgcctgtgcttttgccctcccagccaagcaactctggccttcatctcccttctccttagcacttctcatcatctttttgttttgtttgagacagggtctcgctctgtcacccaggctggagtgcagtggtgcaatcatggctcactgcagtctcaaattcctgggctcaagtgatcctccctcctcagcctcccgagtagctgggcccacaggtgcacatcaccatggtgagacaatttttaaaactttttgtagaaatggggtcttgccacatttcccaggctggactcaaactcctggcctcaagcgatcctcctgccttggcctcccaaatcactgggattacagctgtgcgctgctgtgcccccctcaccatcttttatttttttatttttatttttttaagatggagttttgctcttgttgcctaggctagagtgcaatggctggatctcagctcaccacaacctccacctcccgggttcaagcaattctcctgcctcagccttctgagtagctgggattacaggcatgcgccaccacgcctggctaattttgtatttttagtagagacagggtttctccatgttgctcaggctggtctcgaactcccgacctcaggtgatctgcccgcctggcctcccaaagtgctgggattacaggctagagccaccatgtccatcactatctttaagcaatgctccctctcccacctgagccagaactccctttcccaactgttatatagctgaaacaattggaacactgcctggtacatagtaagggtacagaaatgctacctttgttattattattctcccatctgtacccaggactccttccacagttcccagcagcctctctcccatccatccccagcgtgtacctctccggtcctcccacccccatccccttgctgtcgcctcacctgggctggtcaccgtagtggtaacagttgtcgtggtgatgatggtggtcgtcgtctcctcctctcctccctcaggcccaaggggaggccctggggaggcagggctgggtgggggtggggctgtggttcctgggggcggggtcagcagttctggcgcagtggggcctgcccccctgaccccgttaggggtgacggctgttgtcagaggccctgtccccggctcagtggcccgtggcagggagggcactgcgagagtctggccggccggaggggtggctagcgtggggtcccgatcagatcctgggacagtgcagggaatatcagagcacaggaggagcacatggaggaccttgggtggggagcagggctgagggaagctaggggttcccctgccataccacaaaagcctcccgcacaaggtacagcaccccccacctttcccttccccaccccagcccctacctcctcccaaggcttccacagcctgagtcccccctctttctcttctggtcccttctctccacccagccccttccaccctgatactcctctccctgagcctctctctctgcctcctcactcagatcacgttctctctctggttatctcctctctcctctgtctcattctctctcgaactctttatttccccatttccctgtttagtattctgattgcactctgatttcatgattcgagatccactagtttttgtgtttcattctctctgtctctgtcttccaccatttctctgagtctggttctctgaatttccatctctgtttctatgtgtctgtttttctgtctgactgtcacctaatcattctgtctctgtctctctggttctgtctgtgcccaggtttgactttctctgacagtctcgttctgtgttccctgaatctcacaggaatgcaggctctttcctctgcagtctctctctgcctgctcttctctagcctggctccccatctccctgagcccatatccctccctctgcctctaggccactcctgccactctgggggcctcacctggcaggtagcccatctctgggcccctcctcagcagggccccatgaagcagttcagccagggcctcagaggccaccgtgggggtctcacttccaggctctggcaatatctcctcctccttcaggggcagacctaggaggtgaagttgtgtgagcttctccacttccccacaccccttccttctccagagagatattttctagaactcttcctccctcctccatcagctgggcctgcaggggctcagatggtcccaggctcgactgagggccaagatcggaggaggggctcccagctgccctcatactcccactcccacacctcttctctcccctcccctctcccttctccctgggctgtgtgggccttcattgaacaccttagctcttatggaccctggacagcgccagcaaggcagaggggtcgccggtgctgccttccctttcacctcagtggtgatctccccccaaccctggggctctgcagaggatctggccgcacctcccagcccttgcttccgcagtgcctggctttctctctgggtttctgtctctgcagtgtggctgtcttttctctctctctctctctctctctcccccccaccctctctctctctggtcctctgcagtctctgcctccttccctggagtctggctgggggtcagagtgggggactgaaaatctggtctttgagccctgcctctgctcatctgtctttgtccattcatccaagaacagttgtgtgtacagcgcctggcatctctctcagcacctccatctcccacccaggtccctccatgcttctgccgcctccgcagacatccccccaactttcccagccctccttcttggatctagcccctgagacactgctaaaagcttctctcattcatttctctgccttctcaatattgagggttaaggggcttcgggttcaagcctgaaagctctggcttgccccttccccatcagctgtgcctctcccctcccccatgtgctcggaagacccaggatattaagagaaaggagggtggaggaccccgctggacgccttcctggggcccacccccacagtctcatgtccttaccctggatccagggacagctcagcagaattaggaacagcagctggggaggcggcgggtgctgggccctgggagtccccatggcgactcaccccgatctctctcctctgtgcctctctaagtaatctggctgccacctttcctccgtctccgtttatctttccctttaattgttttttttttttttttttttttcctcgtaggagtcagcaaagaaagacaatttctctgccccttgggatggaggggcagaattgggctaggggtcgcctggagcccacccccctttgctcagtctcctctgtcctcttctcgcggctctgtggtggagggggcgcggctccggctgcagggggtggggccgagagggccgaaggggccgggtggcctgggttaccctcctgctcaggcgcctgggtccactgggctgtctggaccccaagctaggggactggggaggagaaagacagcttctgggggtttagggtggggtcgaggatcgagggggtctccactgggctctagcggggcttgtcggggaggggaaggggtgggttggggaactgggagagccgaagctcgggcactggagctgcgggagggagaagctgagaaaggtatcgagcccacgtcagatcctggggacgggcggagggaggggcctgggatttatttgacggggagggaggaggaggaagtgcagatggaggagggagggatcatacgagccagggccgtaatcctcactcccgcggcccctaggggaggcaaaggaaactctctggtcccagcagtaattagccccctccgcctgccattccagcacatctggaatctgaatctcctcttcccagggtgccgaggggctgcatagcttggttcgcgcctgctaggcccccaattatgccccctgttcacattcagacctcccaaggggcttcccttccccttttacagtagctcgggtggaatgggctctccctcctccaggggaatagagagcttccacgattgtgacaagtctcgtgggtgacgggccggggtttggggaggagagacagacccctcctcttccataaaccctgaccccggccagctaacaggcggcctcggctctgattttccctccggagcgcccttttcagcaccagcggcgcgcggacagctcccctcgccccgccggggcgggcccggcccgacgccgcccgcgattggctgaggccgctttcggtgtttgccaggctcgcgggctcccgggctgcctagggccagcgggagtcacaggccgaccgaccgacggaccagccgcccgacggactggcctcagcatccttgcccgcagtcccgggcgcctgcccagccgtcagtccgcgctcgccccgcccctcaggccccgcccctcaggccccgcccgatacgacccgccccttctttcgcattgcgggacggctggaggctggcaccgtggcccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcagggtgagtgggagcccaggaaggagcgagtaggagagagggagcgagagccaggcaggaccgcagggtcggggctagtgaggagcgagggcaaggagagagcagtgaggccggagagaaagaagctgccgcggaggaagacaggctgcgggttcccgggactgcaggtccaggcagggtaggaaccgctgcccaggggagctaggaggaagcggggagagagagcgagcgaaaagcgggggtggggaggaaagggggagattgaggtgggagagagaagcagagcgagagagaggaggctgctggaaggagaaagaagagggtgaggaggcgacagagggagaggaggaagaagaggtagaaggagagagaaaggggagagaaaggagagaggagggttggaggtgcatgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggtaagtagctgccgcctactgacaacctccttgcctcgatgatttcccccccagacccttctctccgccagagccgtctgctgtctggttctcattgtgcctctcttcttccatggctccctgttgccacccacagcagcatttcctcagcctcggttatctgcacaccaccttcataagctttgccgtggtcattcccatctgtactgcgtttcttcaccttggctctccccccgaccttttgttctacgtatttaaaagaaatatttatagcactatcagtattacttgccctaaatagtactcataaaaagcctggacaacacagtgagaccttgtctctacaaataataaaacaattagccgggcgcggtggcccatgcctatggtcccagctactggagagggtgaggtgggaggttcactggagctcagcagtttgaggctgcagtgagctgagattgtgctactgcactccagcctgggtgacaagaaagtactcataaacacaagctgaaatttaaaaaagaaagctttcaacagtctagaacattctagttaagtgctctagtctctctgatcctgaagcctacacttttttcttttttgaggagtctcgctctgtcgcccaggcgagagtgcagtggcacgatcttggctcactgcaagctccacctcccgggttcataccattctcctgcctcagcctcccgagtatctgggactacaggcacctgccactacacctggctaatttttttttattttgtatttttagtgaagacagggtttcaccatgttagccaggatggtctccatctcctgacctcgtgatcaatccgcctcggcctcccaaagtgctgggattacaggcatgagccaccgtgcctagccctacaccttcttttttaaaagggttggtggggtgtcaaagttacagtagcaccaaactgagattttttctttttcttttttttttttttttgagacagggtctcactctgtcacccaggctggagtgcagtggcacaaacatggctcactacagccttaacctcctgagatcaaaggatcctctcacctcagcctcctgagtagctgggaccacaggtgcccaccaccatgcttggctgattttttaaaaatttacgtaggccaggcgcggtggctcacgcctgtaatcccagcactttgggaggctgaggcaggcggatcacctgaggctgggagttcgagaccagctgaccaacatggagaaatcctgtctctactaaaattacagaaaattagctgggtgtggtgtcgcatgcctgtaatcccagctactcgggaggccgaggcaggagaatcacttgaactcgggaggcggaggttgcagtgagccgagatcacaacattgcactccagcctgggcaacaagagcgaaacttcatctcaaaaacaagaaaaaaaaattgtgtaaagacaggctggacctgaactcctgaactcaagtgatcctcctgccttggcctcccaaagtgctgagattacaggcgtgagccaccgcacctggcactttttgatgtcttaaagactggaagaaaatggaaaaggaaataattttctgttattccatgccatgaccttgttttgcccccaatcatctcctgtgctgccagctggatgtgtcctacacttcagggcacactagcctcaggatcagttcccaatccttcctctcttccctctctctgtgctctaaatcatgaaaaccttctggccaatcctgacagatgccacatgtgctgttcttttcaacctagaatccccttcccccgtaccacctcctgaaaaactcctactcagccttcagtactcaagttttcaagtgccacacttcctctgggttggcttcctgttcccccatcagttgagttggctgctcactttcctcacagcactcagccatgtggtccttgggccaggaacgtctttaatcttatacctctcagtgagacagcgcctatcacacagtaagctcttgagtcaaactgtcgaaagcccaggaggaaaagccatttcctccaggaagccttctcttttctcgaaatgagaggttgctgccaggtgccgtggctcatccctgaaataccagcactttgggaggccaaagcaggaggattgcttgaggccaggagttcaagaccagcactgtctgtataagaataaaataaaataaaataaaataaaataacgggtctggccaggtgcagtggctcacacctgtaatcccagcattttgggaggctgaggtaggcagatcacttgagctcaggggttcgagaccagcctggccaacatggcgaaaccccatctctactaaaaatacaaaaattagccaggcgtggtggcaggcagctgtaatcctagctactcgggaggctgaggcaggagaattgcttgaacctgggaggcggaggttgcagtgagccaagatcatgccactgcactccaacctggcgacagagcaagactacatctcaaaaaaaaaaacaaaacaaaaaattaaccctgcattgtagcacatgcctgtaatcccagcagctactcaggaggctgagacacgagaatcacttgaacctgggaagcagagtgagctgagatcacaccactccactccagcctgggtgagagagtgagactttgtctcaaaaaaaaaaaaaaaaaaaagatgggtcacactacccacagcagcgtttccctaatctcctagcacttccctcctccaggactgtattgtaattatactgtggccactttctggaaagaaaggaggatgaccacaaaacctggcatttaagacacttagagctagttgctaattgactggccaggatgggcccctgggatggaggcaggagtgctggatgcccgcgtctcttcttacaggcctaaagatccctcctggctgtgagctggtggtcggcggtgagccccagtgctgggctgaggggcactgtctactggtggacgactcttttctacacacagtggctcacaatggtaacggggtgcccattctgcaggggggatgagggactcaggagcaaaggagcgttgactagaaggcagcagaatcaggcccaacggacttcctgtcctaccaccaccatcttccagctgcatgaccttgaacaagccgcataacttctccaatgccctaggaccaccaccttcttcatcaagtaactgcaaggattaaatgagataatattacgtacacagaaaagcggttaccagcacaggactctgggttcctgtcctacctcttgcacttgggcaaaggacttaacctccttatgcctctgttgctttgtataaaatagggataattatggtaataccacagtttgttttgatgattaagagttgatacatatcggccgggcatggtggctcacgcctgtaatcccagcactttgggaggctgaggtgggcggatcacctgaggccaggagttcgagaccagcctggccaacatggtgaaaccccgtctctattaaacatacaaagaaattacccaggtgtggtgatgagcacctgaaatcccagctactagggagactgaggcaggagaattgcttgaacctgggaggccaaggttgcagtgagccgaaattgcgccactgcactccagcctggtgacagagcaagactccatctcaggaaaaaaaaaaaaaaaaaaaaaaaagatttgatacatttaaagggttagaacaaggcctgccacttatttactgtttgcttttatggtgtttggtgagtgctctggtgtgcaagtacctaatgtcagtggctctgctgttcctgtcccatgtgccctaggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatggtagccaggacctcctctctactgcgggggtgggcgggggcggaggatgggaactggctagtgagcactgaaatataaattctgaatcctctcctaactcccgactacttccttcgcagggagaggctggggcagggccttatgtcttctcctagtacaaccaaacaggtacctccttttttttctttcttttttttttttttttgtagagtcagggtcttgctttgttgcccaggctggtcttgaactcctgggctcaagtgatccttctgcctcaacctcctgagtagttgggattacacgtgtgagccaccacgcccggccagatacctcctaacacaggcatctccccgtccctctccccaggagccagcaccagtttctcaacttaactttatttcaataatttaatagaaaattaaaataataaataatatgaaacagactgataacgctgagctgggcaggcccaggccagtctagtacaaagttaaggaggtagggaggatggtggggaggagggggcggactaccctgcaggacgcgggaggctgctcagactgtggtgatgtcaggaagggccgcacactttggcatggacgatgcactaaaaaaagagaaagggaattctaaatccctcttaaccagctggagagggaaggacgcagggccagggtggggacaagtgttggcttcggaaggctctgagtggtggggccggaatgtaccatgttgttagcaatggggttgggatgggtggagaagggccaaagtgagctgtgccatgcaatgaagggacagaggaggacccacgacttggccagcagagccggggcaaaagtctgggaaggggagggaaagagagagggactgggtcccaaggcaagaggaaggcagggggagggtcagaggtcagtccttgaagacaatttgttggccatgaggacgctcgtcgtgggtgatatggcgccggacatggatcctgcggacacggtgctctcggttctcttcatcctccccgcggccagccccaccagctccagctgctccccctgtggcctccaggagggctgggtctgggccccggggagtctcgtagatgaggatgttcagggtctcctcgaagatccgggcctctggaaattccacctgcaaaaggccagccggccccagctccttccttctggtgcagtcacgcagggccatccccctgcctagggcccctgcaccaacacacctcctagccctgcagtcaggtccttgggcctggcctggcctctctgccactcctttactcagcaaagtcatacttcaaggctcagctctgaagtcaggcaggcagaattatttgttttctctccttcatctccttccctgcctagcctcttggtatattttttcatttgacaaatactgagtgagtgcactgcaccaggtattgttctaggcactgcaaaaatagcagtgaacaaaacaagagttctgtcctcaggaggttacattctagtgggaggactcagtcatacacttaagaaaatataaactagcctggcgcagtgactcaggcctgtaatcccagcactttgggaggccaaggtgggaggacagcttgaggccaggagtttgagtctagtctgggcaacatggtgtaaccccatctctaccaaaaatacaaaaaattagctaggtgtggtggcccacacctgtgttcccagctactcgggagactgaggtgggaggatcacctgagcatgggaggtggaggttgcagtgagccaagattgtaccactgcactccaacctgggtgacagtgagaccccatctcaaaataaataaataaataaataaaataaaatataaatgcagtcaaatgatgatgtttaggaaacgatataagctgggtgtggtgtctcctgactgtaatcccagcacattgggaggctaaggcaggaacatcgttagagcccaggagttcaagttcaaagccagcctgggcaatgtagcaagacctcatctattaaaaaaaaaaaaagagagagagagagaaagagatacatcaggaaaagagatacatcaggaaaaggggatgtgatagccagagccaggagtgttacaactttaagaaggactccagggaaggcctcactgagaaggtgatatttgaccaaaggagtgggggaggggacaaggcacacagagcagaaagagcagcctggggagggccagggccagcgtgagagctgtgggtcaggagtgcacccagtgtcttactggaagatcaaaagggaggccaatgcaattgaggcagagatgagagggaatggaaagggatgaagtcgaagaggtgactggggtgttcccttgtgtggccttggaagcatctaacacagctcttagcaaactgtttttttaattttttatttttattttttattttttcctgagacagagtcttgctctgtcacccaggctggagcgcaatggcacaatctcagctcactgcaacctccacttcccaagttcaagcgattttcctgcttcaacctcccggagtagctgggattacaggcatgtgccattatgcccagctaatttttggatttttagtagagacagggtttcaccatgttgtacaggctggtctcgaactcctgacctcgtgatctgcccgcctcagcctcccaaagtgctgggattacaggtgtgagccaccatgcccggccttttttttttttttttaatcgttgtttgtttgtttctaagacaagatctcactctgttgcctaggctggagtgcagtggtgtgatcatgtatccctgcagcctcaacctcccgggctcaagtgatcctcccacctcagcttcctgagtacctgggtgtaccactatgtccagttaatttttttttattttttgtagagatggggtcttgctgtgttgcccaggctggcctcaaactcctggccttaatggtcccctgcctcagcctcctaaagtattgggattacaggtgtgagccatgcactctaattattggtttatcttcctatcttcccaatcagaggatgtttcttggaagctgggtcactgattcattcattcattcattcaataaatgtttcctagcttccactgtgtgaaaagggcccagctaatgggagataggaaagaaaaagacatggccctgccctcaaggaactaacacctcgctgctgatgcaaaccccctcccctccaccacacatgataaaacactgtctttagctatgaagggagtgtgaccaactttggggttgctggattgaaagttcatgagtgaaggtgacccaaagaaagtgatgcttagcttgagtcttaagattaagtacaagttcattaggcagatagaaggaaagaattccaagaggcaacagtgtgtgcagaggtaagaggtaagaaatagcactgagtgcttagagacttgtgatgactgtggtgtacctgaggcatgtggctcatagtaagctcggaagggaccagatgaggaagggcttgtattttgctcagcacttcattccccttgatttccagcccggtacagtacttagcacagagcaggggcttggggaatatcttgatgattgccacattaatgactcaggatctacaaactcagaggatgttctaagagacatctgattctgaggttttaagaatctatttttggcaatgggcctttctgagtttcccttttttttttttttaattagagttagggctcactctgtctcctaggatggagtgcagtggcatgatcatagctccctgctgcctcaaattcctgggctagggcgggcccggtggctcacacctataatccaagcactttgggaggccgaggagggcagatcacttgaggtcaggggttcaataccagcctgaccaacatggcgaagtctctactaaagagacttctctactacatttagtctctactaaaaaatacaaaaattagccgggcatggaggcgggtgcctgtagtgccagctacttgggaggctgaggcaggagaatcacttgaatctgggaggcagaggttaagtgagctgagatcacaccattgcactgcagcttgggcaacagagtgagactctgtctaaaaaaaaaaaaaaaaaaataggctgggggcagtggctcacgcttgtaatcccagcactttgggaggctgaggtgggtggatcacgaggtcaagagattgagaccatcctggccaacatggtgaaaccccgtttctactaaaaatacaaaaattagctgggcatggtggcacgtgcctgtagtcctagctactggggaggctgaggcagaagaatcgcttgaacctgggaggtagaggttgcggtgagcggagattgtgccactgcactacagcctggtgacacaacgagactccatctcaaataataataataataataataaataaataaattactgggctcaagcaatcctcctgccttagcttcctgagtagctgggattacaggtgcatgccatcatgtcaccaagccaccacacctggctaaattttttgacttcttacagagatcaggtcccacgatgttgcccaggctggtctcgaactcctgggctcaagtgatcctcctgccttggcctcccagagtcctggggttacaggcgtaagccactatgcctcaccccttctgagtttctaatggcaactatggaccccctatacagaaaaatgcatacacccccatttcaggagttgcaaacagccttgaaacccatccaacaggcctaggctaagcaccctgctctaacccgtgacccccatttcacagagaaacagagacccacagggatagggtggcttgcccactgttgtgcaccccagaccccaggatctggctcctgcctcctggtggtgggctccttcccctgccaacctgcttttgtccagggtcctggtcctggccacccccagcccccaacataggctctggagcccctctgaccttggtctgcttcttctccgtagcatagacaatggaggtgcagcacacctcggcgattttgcggccctgcccgtagaaagaccagcagcagatctcgtcccccaggacatccttgaggaagagtagccgcccgtggaagcgcagggccagcttgtcgaacagctcgatgttcttaagtaggttgtcatctgaagtgctggggaccaggggaccaggaggcctcagcgcagttggcacccctccctctgtacccccagaagacgggcctggatgcattcccagtcctctgctcctgcccagggctttggtgctcaacagagagcctcctccacccctggggccaggctaaacgggtctcagaagggaagccacatgcgctgagcaaatcccagcacagcacagcacagcagctccagtgagggaccgggagccaggccacctccccgggggtcctggtgtccccattttttaactgggtgacactaggcaagttacttcacctcttggtgtcccgacctcctcatctgtaaaatggagctcacaacagtactgacctcaagggggaggactctgccagttcctagaatgagagcacttgggataggctcgccactatcactttgtcctcacccaaacccatttactgatgactgagctgaagctgagaagcagaaaggacctgcctagagcgtcaggggtaagaggcgaagccgaatctgcgagcaggcacagatgttcttgtaggccccccgtgtggccgtggccctcgccttgggcagaagcagggctgtgctgcatcccagggtcccgcccagtgccccgcaccccggcggtcacctggtgtaggagtacttgttgttactgcggttgtgcaggagcttcaccacgggctggcgggggagagaggatggacgagaggggtgaggctgcagggagaggcccccccagtgagcctccaccctgcagggcttgggggcctcaccttggaggtgctggccaggagctgctgctcctcccggggagatgtcaccatggggatgaggcacagcggggacagcgtctcccttttttgctggggaagaagcggaaggtggttaacagcacaaccaaaggccacgtactcccccacttaaaagccttcaaaagctggttgggaacaactccagactcctcagtggtccgcagggctctgcaggctccaagctccgccagcctctctgccactctccctttgcttgctgggccttggtcccacggacaccttgctgcttcacacatccagcttgtgcctgccccggccactggctgtgcccctgcccgggatgcttctttgctcagctgtcagcgtggcgtgtccgtcatgccattcagatcgcaggtcacacagtgcctcctcagggccagccctccccagcccccctggctaaaacagcctcctctacatcctgccttttgtgttatcagttttctttttctttttttgagacagagtttcgcttgttgcccaggctggagtgcaatggcgccatctcggctcactgcaacctccacctcccgggttaaagcaattctcctgcctcagcctcctgagtagctgggattacaggcatgtgccaccacacccagctaattttgtatttttagtagagacgaggtttctccatgttggtcaggctggtcatgaactcccgaactcaggtgatcagcccgcctcagcctcccaaagtgctgggattacaggcgtgagccactgcaccaggcctatcagttcattttctacacagcagttagtgtctgactttttctaactttttgtatttgtttatgatctgtctcttcccacctaggaataactacctagtatacagctgatgctctgtatttgttgaatgaatgaacatatttgttgagtgaatgaacttcattgggtgggatgacgttggagaaagaaatctgaagcaaacccatgggcttctttctcttctgtcttctagaatcttcatgccaaaatccctctcacttctcccaaccttgaaaactcaatgcgcaattctaatacaaattccagatttgttttttgcagaaactcataagactctctaaaattaacagagaataataaaagtctacaattactgaggccattttttttttttttttttttttgagacagggtcttgctgtcatccaggctgagtgcagtggcatgaccacagcttacagcagccttgacctcctgggctcaagccatcctcccaaacttaggtcagtttttaaaaataagagcaaagaggaaaggccgaccctgccagatattaagataggctgcaaagccacaacagtgagaacggtatcagttcgggcacagaaacaaaaatacctgagaaacacaacagagcgatcagaaacagaccactgtgtatatgagaattggtatttttaaaaagacaccacaaatgtgcgaggggaattacggagtatgaattcgttatctatcactgtgtaacaaactgcccccaatttaggagcttaaattaacaatatttattacttctgtttctgagggtcaggatctcagcagtggctcggctgggtggctccggcacagggtctcttctgaggctgtggccaagatgtcagtggggctgtgggcatcaaaggcatgaccgcccctagaggatgcactctgagaaagcttgttcatgtggctggcaagttcgcactagctgctggcaggaaacaacaaatccctgccatgtagatctctccacagggttgcttgagtatcctcgcagcatggcaactggcttctccagagcaaataattccagagagggcaaggtggaagcctcattgtcttttttatttttgagatggagtctcactgtgtcgcccaggctggagtgcagtggcgtaatatcggctcactgcaacctccgcctcccaggttcaagtgattttcctgcctcaaccacccaagtagctgggattaccgaggtgtgccatcacgcccagctaatttttgtatttttagtagagacagggtttcaccatgttggccaggctggtctcaaactcccgacctcaggtgatccactcgcctcagcctcccaaagtgctgggattacagacgtgagccacagcgccgggcccctccattgtcttttatgacctaggtctgttggtcctatccagtgaggaaggagatgacacacaggaacgagcaccaggggacgagaatcatcaggctgccttggtggctggctccacaggccaccgctggctctcagtgatttcccccctcccacatgccaaatatactcaccaccttccaggatcccccatcatcccattacagcatcagctcaaagtacagaatctcatcatctcagtcaggtccaggtggggatgtggctctagcatgcagttccgtaactatggctccttaagtgcatttcttttttttttttttttttgaaatggagtcttgctctgtctcccaagctgaagtgcagagccaccaccatctcacctcactgaaaactctgcttcccaggttcaagtgattctcttgcctcagcatcccaagtagctgggactacaggcatgcaccaccatcccagctaattttctttagtagagacgggatttcaccatgttggccaggctcgtctttaactcctgacctcaggtgatccacttgccttggcctcccaaagtgttgggattacaggcgtgagccaccgcatccagcccttaagtgcatttcctatctgcagacctgtgagctaaagagacaggtcatctccacactcccagtgtgcagtggtagaggcaggcacaggataaccagtaaggacattcttgctcaaaagcaggggaagccgggcgtggtagcgtgtgcctgtcatcccagctactcaggaggccaaggtgggaggattacttgagcccaggagttcgagaccagcctgggcaacatagcaagactctgtctcaaaaaaaaaaaaaagtggggcaggggacaggaggcacatataagtcatacatataagtcactggtgtgtggaaattctgtaatccagttggagaaatgctaggaactctttgatgcctactcctgttcatgaatgattctccatggctctccctgagtcgtcccacctcttccatgaaagatgtttgcagctccacagtttcatctgcctgcttcctgcctgtaaaagtttgggtgtgcaaagccgtcttgtccttttgcactggctctgtccctttcagtccaagctggcagtgtctctgccaatataattctcttcataacttattgggtatcttgcatgtcttagggttcactacattagaaaaaagccacacctagaaatctctgcaagtggccaggcacagtggctcacgcctgtaatcccagcactttgggaggccgaggtgggtggatcacctgaggtcaggagtttgagactagcctgaccaacatggtgaaaccccatctctactaaaaatacaaaaattagctgggcgtggtggtgggcacctgtaatcgcagctactcaggaggctgagacaggagaatcacttgaacccaggaggaggaggttgcagtgagctatctcaaaaaaaaaaaaaagaaaagaaaaagaaaaaagaaaatctctgcaaggtaagcccttctctactttgggcttgtgctgagacgctgaaagacaacacctttaaccttctcagaagcgtgattattatttcattcgactggaagtcccctctgaggcatcttgttggtatttctgaggtcttaacaaaggactttttcatcacatcctcagcttgacctttagaccacatttccctgtatttaatgccttgtatttaatctttgcacggaagccatttgttaattttaacatcacttgttatctggaaaggctgggaattttcaaacccaacaatttcaggctctttttcatttaagtgttttttttctttaacttactctctcctcttcagttttactataagcagcaagaagccaggtggcaccttcaacattctgtctggaaagctccttagctagaccatccgttccttaggtatatttcctaccctccacactaatgcaggagacagtgttgctaaactttctgccgctacacaaggatctcctttccatcagtttccaatagcattttcctaactgttcttcaagcccttattgcagctgtcttaaaggtcactggactcttattaacagactttctcaccttttttcttttaatttttttagagacaaggtctcactatattgctcaggctggtctcgaactcctgaactcaagtgatcctcccaccttggcctccaaaagttatggtattacaagtgtgaaccactgtgcccagccaatactttttaacactccttaagcttttactaacaatctcctcaaagtccttccagcttcttcccacttctcagttgtaaagttacttctacatttgaggtttctgttatggcagacccccattccagaaaccaaagtctgttctctgttactgggtaacaaattactacaaactcagcagcttaaaacaacagtccaggtgtggaggctcatgcctgtaatctcagcattttgggaggccaaggctggaggactgcttgaggtcaggagttcgagaccagcctggccgacagagcaagactctgtctctatttaaaaataaataaataaaaataaacattatctcacatagtttctgtgggtcaggaatttgggatgggcttagctgggtggccctggcccagaatctgtcatgaagctgcagtctggattttggctagggctgcagtcatcagaaggtttgcctgggcctagaagctctggttctgagacaggtcaccactatggcggggagtctgtgcttgctgtcggcaggggcttcagttcctcaccaagtggacctctgcttagggatgcctgagtgtcctcacatagcattcacatagagtgagtgatctcaaagagaggcagaagctgtaatgtcttttatgacctagcttcaaagtcacatgctgtcatttctgcaatgtcctattggtcatacacaagggtctccttggtgaggatctgaaaaggtctgccctatttggtgtgggaggggactgaacaagagcctggaaaccaggaggcaagaacccctggtggctgtcttgggtgctggctacctctggactgtttaatacctggcactgggaaaactacctcaccctatggaagacaaaaatgagctaaatcccttcacaatcatatttacaaaagtgagttccatttagattaaaatacccatatatgaaaaaaatccatatttaaaactataggtcaggtatagcggatcacacctgtaatcccagcactttgggaggccgaagtgggcagatcgcttgagctcaggagtttgagaccagcttgaccaacatggcaaaaccccctttctacaaaaaatacaaaaattagacgggtgtggtggctcatgcttgtaatcccagcactttgggagaccaaggcgggcggatcacgaggtcaggagttcgagaccagtctggccaacgtcgtgaaaccccatctctgctaaaatacaaaaattagccaggcatggtggtgcacgcctgtaatcccagctactcaggaggttagggcaggagaatcgcttgaacccgggaggcagaggttgcagtgagccgagatcatgccactgcactccagtctgggcaatagagtgagactccatttagaaaaataaaaaataaaaaatcagccaggtgtcatggtgcacgcctgtaatcgcagctactcgggaggctgagacatgaaaattgtttgaacctgggaggtggaggttgcagtgagccgagatgacaccattgaactctaacctgggtgacagatcaagactctgcctcaaaaaataaaaataaaactacaaagctcacaggtaacagaaaatcagaaaaacatttttaaacaagaccataaggatacagcattaggcaaaaaatggtgaggaattggactacatccaaatcaagaatttttcaagttgacaatggaaagcatgactttacaaataatctcatgtaataatgttgaagagaaaagacttataggtattctgtggcacaaatgtaattactggttcaggtaaggattatcaatttgtgtgtcattgataggtaactgccttaatacagtggccaaataccatatgcattattttatagttagcaacaaggaaatgtaacaatgatagagaaatcaaaccaccatcccctagatccaggggccaattatgaacgtcattaatgacgagtcatattaacaatattatgggttgcttgatgtggcccaacgtgaaatacatacataatattacctaaaatgtattctaaacaaaatgtttaatatcagtcattttatttattttattatttattcatttattttgagacagagtcttgctctgttgaccaggctggagtgcagtggtgcaaccttgactcactgcaacctctgcctcccaggttcatataattcttctgcctcagcctcctgagtaactgggactacaggcacccaccaccactcccagctaatttttgtaattttttatttatttatttatttatttttgagatggagtctcgcactgttgcccaggctggagtgcagtggcacgatctcggctcactgcaacctctgcctccccaggttcaagcgattctcctgcctcagcctcctgagtagctgggattacagatgcccaccaccaggcctggctaatttttttgtatttttagtagatacagggtttcaccatgttggccaggctggtcttgaactcctgaccttgtgatccacctgcctcagcctcccaaagtgctgggattacaggcatgagccaccgcacctggcataatttttgtatttttaatagagatggggtttcaccatgctgaccaggctggtctcaaactcctgacctcaagtgatccacctgccttggcctcccaaagtgctgggattataggcgtgagccaccgtgcccacccaatatcagtcatttaaaatctacagtctggtttacaggaaattaaggataaggctgggtaataaaccaaacgataccgggagtaaacaaccaggcaaagttggaaagcgggtcattgtgcaggacaactggcagtctctttaacaagccagcatcgtgaggaaaaagggaccccttggattgtaataaagtaatgcttatggtattatttggcttatgtaataaagtaatgcttatggtattatttggcttatgtaataaagtaatgcttatggtattattatggtaactgtattaaggcagttacctatcaatgataatccttacctgaaccagtaattacattcgtgccatagaatacctataactcttatcatctcttcaacattattacatgaaactatttgtaaagtcatgctttccattgttaacttgcagataaccagatgcaacgtgaagatctagactggaccctggtttgatgaaccagctgtaaaaacacatttctggaacaactggagaaaccggagtatgccctggactggatattaaataaaaatttattgacatgtaaagatggcaattattaacaacaacaaaaaacagattataaaacatttcatacaacacgattgtattttggcaagcaaatacacacacacacacatactctcacacaggaaacgacctggaagaatatttggtgcttttattttttagattatttgtgtttctgaaatttctacaattaataaatactgctttaaaataatcaatggttatttgtaattttaaaaaatcaaggatttccattcaatgctagatgccacaagtgggtgacattctaagaaaaaatattggcgatatctacattgactagaaatttttatctagaacagactttttcaactgaagttcctcatctgaatctcaaaaaccagcaaatatggccaggcacggtggctcacgcctgaatcccagcactttgggaggccaaggcaggtggatcacttgaggtcaggagttcgagaccagcctggccaacatggcgaaactccatctctaccaaaaatatgataaaattagccaggcattgtagtgcacacatgtagtcccagctacccggaaagctgaggcaggagaatcacttgaaccccagagagggaggttgcagtgaggtaagatcgcgccactgcactccaccctgggcgacagagcaagactccacctcaaaaaaagaaaaacaaaaacaaaaacaaaaaaacagcaaataatttgagtgttttctgaactttgctgagaacagtaggtaaatagtcccatgctacaggcttagaggttaatttgttatgtatataatccatgccctagggaatgtataagacatacccatatgcagtagggcttaattatccctaggaactaaactaaaatatgcaaggatctcctgctaagcaacatgaaaaagaaaaaagcagaaaatctggtaaagaacatgaataagcaattcacaggaagggaaacaaaaaaacactagtgagtatatgaaaagatgctgaacctcattagtaatcagaggcatgcaaatgaaaatgagatcacgctacactcattggattggcaaaattagaaagctggatgatgccatgtcttgatgaggacatgcagaaatgtaatctcttatgcactgctcattatgaggataaagtattataaccattcgggagagcaattagatgatatttactaaaacgccgtttgcaggtgtcctgttatccagcaattctactcccagctacaatgacaggagactggcacagaatcagaagggagcatgtaccaggatgctcatggtgacacggtttgtaggggcaggaactggaaggcaatctaggtctccaacctcaggggaatgtatgaacaaaatatggtgaatgaacaccgcagatttctctgcagctgttagaagcaaagaactagatgtacttggagcagcatgaatagatcttgaaaaaaagtgctgaattaaaaaaacacaatgcaacagaaactgattcacagcttcaatgccatttatggacatttaaaatgcacacatatgcagaacaatgctttagcttttcgagcatatgtatcaaaacattaaaattggatgggtgcccctgggaaaaaggaaagtaggcaggggactgggaatgaagggaaagaaataaaactaaaagacaaaaggtttgcatagaccaatattgatgaagtgccacacactgaggagtgtgctgagctgcgtgaggtgcagagggaacctggaaaggagagagcaggagtatagaaaagtacagctcttgggaggctgaaggtcagatagtcaggtagcctggggtcaaatctgagctctgctgcttcccagctctttcaccttggacacgtcttccaagctccctcgcgtttctttttacgtcaaacaaggatacaagatgtatacacaagcagatagcagaattgctcctgacacacagtgggtacatgatgacattagtaaatttaaaactacaggccgggttttaaaactttagttttaacattagtaaatttaaaactacaggccggtggctcacgcctgtaatcccagcactttggggggccaaggcggatggatcacgtgaggtcaggagttcgacaccagcctaacaaacatggtgaaaccccgtctctactaaaaatacaaaaaagtagcaaagcgtggtagcaggcgcctgtaattctagctacttgggaggctgaggcaggagaattgcttgaacctgggaggcagaggttgcggtgagccaagatcacgccattgcactccagcctgggcgacagagagactctgtctcaaaacaaaacaaaaatgctacagagcaggaatgcacttccaagatctagtacaatgaatgtttctcaaatgcaagtggtaatttattaatgggtcatgaaataagtaatgggtcccaaacagcattaaaaagaaagattatcagagtacatttcactaaaagtatctttttatagaactgttatttcagttatatataatgagtactaaaatgcattttttccctatggcaggcaatcaaaaagtttgaaaaacatggatattgtccaaaggagttctacacctttgggcttcaagaaccagtaagtattccctgagacaaaagttgttcagggaggcaaccttttaatctataaagggcattcaaaaagaaacttttataatcttctcttactattgtaacataaaagaaaggacatttttaacattgtaaaaatagaacagaataacaggctttatgtaaaactcactactttgtacttatttttctcccttccctgtctttcggaacccgaggacagaatcccagaggtaggaatggactcactgaaggtcactgagtcagctgtgacagaggtgacacagaacccttatgtcctggcttcactttccaagctctgctcctcagaaccctaaggggtccacaaaagtggagcctagcaggtggggtctctagaatccccaaccctgttttactgggagtggccctgcttctgtgagatttcatttgaataaagaatttcactgtttaaaaaaaaaaaagaattagaaagctcctggggggcggaagccatgggagaatgctgcctcccaggatagggccagatcgcagaggttattatatttcaatttaaatttagatgtttttccctagtgacatgagggagctatttaggatttctaagcaagagagagaatagatcggggttgtgctgaaagataattactcaggtgcgagtgtaacagctggactggctgcataggaacagtgggaagtagagagcagctatttaaccattgcaaaggtcctggcatgaggctggggtgggggtgctgcctgaggcggcagggatgcagaagatggcacctcaaattctctggggttatggccagccaaagccaggctctccaagccataccccatatctccttttttctgctctaatacctgcttgggcagctctcccaggaacataggcatggggactccgaaggccctcacctgcagcgccagctggcagtcctcaatcaggccctgcaccaggtagtagcgtgcttcgcccagcagctcccccagttctctcgtactctccggcagtggcacagacccatcccgcaggtaattgaggattgtaccaaagtgacggccgctccggtcaatcagcacccaacctagtggggtggggagaggcagggggaaagatggctttgctgcgggacctggagctactaaattaaaaaaaaatttttgtagagatggagtctcactatgttgcccaggctggtcttgaactcctgggctcaagtgatcctcccatctcggcctcccaagtacttggattataggtgtgagccaccaaacctggcctaaattataagaaaaaaggattccagccaggcgcggtggctcatgcctataatcccagcaccttaggaggctgaggcaggcagatcacctgaggtcaggagtttgagactagcaggaccaacacggagaaaccccatctctactaaaaatacaaaattagctgggcttggtggctggtgccagctactcgggggggggcgaggcaggagaatcgcttgaagccgggaggtggagtttgcagtgagccgagatcgcgccattgcactccagcctgggtaataagagggaaactccgtctcaaaacaaaaaaataaaaaaagaaaagtaaagaaaagaaggccgggcacggtgactgacgcctgtaatcccagcactttgggaggccgaggtgggcggatcacctgaggtcaagagttcgagaccagcctgaccaacatggagaaatcccgtctttactaaaaacacaaaattagccgggcatggtggcgcatgcctgtaatcccagctactcaggaggctgaggcaggagaattgcttgaatccgggaggtgggggttgcggtgagccgagatcgtgccattgcactccagcctgggcaacaagagtgaaactccatctcaaaaaaaaagaaaagaaaagaaaagaaaagaaaaaggattccaaagccacaaaaaagtctgaatactgatctgtctcaaacctgtgccacagccaagaaatctctttaaaacatctccagcgagttctcccttaagtttttatacatattcaaccagataattaactcatccatatctggtctacagtcagaaggctctcaccatgagaaagttcttgcagaattaccttatcaataaactgttaacccccgaagttaattctcaccatcctatttaattaaaatgtctacctccccccgtccagttcactgccattttaacttttatattcttcatagagcttactatcaaaaaaagaaaaaagaaagaacttactactatctgcaattgcatatgcatatacattttgtttacttgcttattggtcttctgatctcccacttccctaaaaaaagggaatttccataattttgtcaggttcatttacctatctccagcactaactgatattttacaaatacttattggacaaatgaattcttcccttttttttttttttttttgagacagtctctctctgtcgcccaggctggagtgcagtggcgctgtctcggctcactgcaacctccgcctcccaggttcaagcgattctcctgtctcagcctcccgagtagctgggctacaggcgcacaccaccacgcccggctaatttttgtatttttagtagagacggggtttcgccatattggtcaggctggtctcgaactcctgacctcaggtgatccaccgcctcggcctcccaaagtgctgggattaaaggcgtgagccaccgcacctggccgaattcttcacctttgatacttgaaggcagatctccgcctctcaaatttttattctcctgctctcacagtcctcgttaacccctcccttaagactctcccactcccaaactccaaaacttcaaagtctcacttgggcacgaagggtccatacttgaatgcaacactccaagaaggtaaggttcacctgccaaggagacctgtccaccctccactctggtgtccctggcaaacccaaagcagcctccttctgcaatgtgtgtatacaggtggattcctagagtgtacagggacctgtgtcaggggaacacagaggcaaacaagatctcccagctctcctggctggctgtgagcagttctgaagcagagagggaaacaaaaggctgggcagtcggaagaaactgaggaaggctgccaggagtagtactgcaggcagcagggctagttcccaagtcttgagctgaggggtgaagggtgggagaggtggtcatgaggattatgaactgacacgttcaatcacttaccacagcgcctggcagttaggggttccgtaagtgttggttattgctgggggtaaaggattgggggaggagaagagaaattatgaatgagaaaggggaggagatgggatgtgggggctggagggagctgagaatgagttgactggacagtagcgggcagagagaaggggcatgaggagccccggtggtgagagactgcggggaacgggagttgggggtctggggtgggggcacggtaggggcgccgctcgtacctccggcatcggtcagcacctccacgcggccgctgaacatggctttgagcatggtgtcctgtcccgtgagggtgcgcagcgtggtgtagtgcaacgagccgcccacgttcagcttcacgtatttgctgttcggggtcagcggcttgagaccgtaggcggcggggccaggctcgagacccgagggcttgggggcttccagggacggggccgcggcggcagccgggcccgaggcctccgccgacatgccgggtagcagcggcggacggcgatcccaggatctctccgcgccctgcggcctgctcccgaagaccctcggccggcccccagcccttgggccagaccgctcggcgcacacgcccactcaccgcagctactctgcaagaccggccctccgccccatctcgctcgcaccacccggaagccggcgccgggcagctgcgcaggcgcggccccgcccctgaatgggggcggggctgcgagtatggagcatgcgcagtggcctcgctgggggatcccgtagaggtttggcgtgtggcctgcgggttccccgggcgggtcgacgtgcgctcctctctggtctcgagtcaccaggaccagatcgaggatgcggccgaccccctgcccgatgtggaaagcgaagtctccacctcgtgattgggtctctgctgtcagagagcttcacgagcttgaggggaaacagacagagaggtctgggcattgggcagtttcccgcctcccagccccgcgcactgaacagactgtgaccagaactgcgaacaaagcgcggagggaagctcttaaaggaggccaaagcggccgggcgctgtggctcacacctgtaaccccagcctgtaagcctagctactcgggaggccgaggcagaaggagcgcttgaagccaggagttggaagctgcagtaatccgtgatcggaccgttgcactctagcctgggcaacataacgtcctttgaaaaaaaaaaaaaaaacagaggccaaaacgggtagcagtggtgcccgggcaccaaggatggaaggcctctctgaggaggtgatgccgagctgaagctgggaagcggatgtgagggaagagttccaggcagagggaaggcaaatgcagagatcctcaggcaggaacactgaactgttctccgtatttgaggagcagagggcgtgtcagtggtggccgcagcagctgagcaaaggtcttagaatcccagctaatgtcgtgggacctagcacccaatcccaaaagaaagaagaatagataggaacccactgttgacaagaaggtgcactgagaagtgtttttatctgacccgatctgcatccagtttagaagccgatacatcagggatttaacaatctgtcttaatgtctagcaaggggggttgctggagggaaaacacagagtcagagttctatcttcagccctgccagcaggtccctgggagatgctagacgagtgacttttctctgggcgtggttggtgtaagggatgcacacgcaggaggaaggtcggagtgtaaatgtgtgacctgggcctgttactgggtataaatgggcctgtagtgaccgggagctcatgttctaccaaaggggttgccaattttctgatttcgagtgtggcggtgtaaaagagaaaagcaactgctgccagctgggagctggtttgcaccctcactccagaagccttgatgttgctaggagctgacctggcaccaacagcacggccatggtggtgtcctgttgagcaaaataatttcacaaaaaacatcagacaaggtcactctctgactgatctagaaaaagaccattccataataaagcctcaatacagaaacaagaacattgtccaaaccacaaaaattaccaacacaatcctctctcccacagcgtaagttactgctgctttttttttggttgttgtttttgtttgttttgttttgtttttgaaatgaagtcttgctctgttacccaggctggagtgcagtgatgcaatcttggcttaccacaacctccacctccaggttcaagcgattctcctgcctcagcttccagagtatctgggattacaggcacccaccatcatgcccagatcatttctgtatttttagtagagacggggattcaccaagttgcccaggtgagtcttgaactcttgacctccggtgatatgcccaccttggcctcccaaagtgctgggactacaggtgtgagccactgcacctggccactgctgcttctttaccaagtacagttttagcttgattcattcctcccatcttctagataagaattattaagataaccaaaaagaattatccctacttcctgatagcatccaacccagagcaaatgcccccctttttggacccgcctaggaagtcccctaatgaaagttccaatcctgtaataagtcctttcacacatgttcttgctgagatgtctgtggtgttcagcctcccttgttcaactacaggtgcttcctggtggtccttggttggagggtactatcagaaatggaggagcaacaaagattcagctgaagccctcactgcctgggactgggacccttgactcgtcattgtatgcacacctgaaactgcttatgtcgctgaggtgccaacctgctgatggttggaagctaattgagttctgatattgtgttgatacccttaagcattgggtttactttttattttaattaattaattaattaatttttgagacagagtttcactcttgttgcccaggctgaagtgcaatgacacgatctcggctcaccgcaacctccgcctcctgggttcaagcagttcttctgcctcagcctcttgagtagctgggattacaggcatgcaccaccacacctggctaattttatatttgtagtagagacagtttctccatgtttgtcaggctggtctcaaactcctgacctcaggtgatccacccgcctcggcctcccaaagtgctaggattacaggcgtgagccaccatgcctggccatattttttatttttcattttttactttttgagatagggtctcactctgttgaccaggctggagtgcagtggtacgactcagctcactgcaacctctgcttcccagctcaagtgattctccagtttcagcctcctgagtagctggcactaaaattaaccaatgccggttaatttttttttttttttttggcgggggacagagtctcgctctgtctcccagagtggagtgcagtggcgctatctctgctccctgcaagctctgcctcccgggttcaagcaattctcctgcctcagccttctgagtagctagggttacaggcatgcgccaccacacctggctaagttttgtatttttagcaaagatggggtttctccatgttggtcaggctggtctcaaactcctgaccccatgatctgctcaccttggcctcccaaagttctgggattacaggcatgagccaccacacccaggaatgccggttaagttttatatatatatttttttgtagagatagggtttcactctgttacccaggctggtctcaaactcctgagctcaaagcaatcctcccaccttggcttcccaaagtgctgggattatagatgtgagccaccatgccctgccaagcattgggtttatttggtttttcagtttttttactcctggaataaggcccccacactggatttttggttatctgatcaaatatttattttgtccttggtgcaattgttttctgtccttctacactcattcctatggtgttttcttgtctagtattttgaatattgtttgtctataagaggcaaagtcgatataaaaaggatggatgtaggctgggcgcggtggctcaggcctgtaatcccagcaactttgggaggctgaggtgggtggatcacctgagatcaggagttcaagaccagcctggccaaaatggtgaaaccccgactactaaaaatgcaaaaaattagctgggtgtggtggcaggtgcctgtaatcccagctacttgggaggccaaggcaggagaatcgcttgaacttgggaggcagaggttgcagtgagccgagttcgtgccatggcactccagcctgggcgacagagaaaaaaaaaaaaaagtctctgtctcaaaaaaaaaaaaaaaagaaaagaaaaggatggatgtgtagcctcggatgtctaagggcatcacaaacctattattgctgaatctctggtgaccgaacacaacttatccctctaggaaggtagggatgccaactgttgaggggttgtgcaactagttagcatccgagagtcttatttgttatcagaattaaccagagaaatcactccagcaaccaagagccagtaagtgtgtcctacaaccagctccagagactgtacaattcggaaggtattctcagactaatgtcctttgggtaaactttgcccaggtcaccatttcttttttgtttttgttttttgagacagagttttactcttgttgcctgctgaagtgcaataggacaatctcagctcagctgcaacctccacttcccgggttcaagtgattctcatgcctcagcctcctgagtagctgggattacaggtgcctgctaccatgtccggctaatttttgtatttttgatagagacagggtttcaccatgttggccaggttagtctcgaactcctgacctcaggtgatccacccacctctggctcccaaagtgttgggattacaggcatgagccaccacgcccagccccaggtcaccatttcaaagccttgaaaaggatttctttggttttgtctatgtccttgcaaactgctttgtttcatttcttctgctcagtatcagggggctttctctggcctctgatcagcgatggtgtttggccacattctagagatacgaagttgtataagcaccattcttttagaccccagtcacaactaaaattgggccaaagacctgctcccttcatgttttctcacgattgcaataacatgtacccatatatctgtaactgacacaatttcaccagggacagtttgtaattgccgtagccatttggtggaacttttgataataacaagattgttcatttgggaggtgcctcagaacacaaagggaagaaacctttgtgagattgtttgccttgtttgttaaaaacaaagattattttgtttaacataggcaatatttcatttacctattttgcatattaataaatgctgtcggccaggcacagtggctgacacctgtaatcccagcactttgggaggctgaggcgggcgaatcacttgaggtcaggagtttgagaccagcctggccaacatggtgaaaccccgtctctactaaatatacaaaaatcagccaggcttggtggtgcgcacctgtaatcccagctactttggaggctgaagcaggagaattgtttgagtccatgaagtggaggctacagtgaactgagatcatgccattgtactccagcctgggcaacaagagcaaaactccatctaaaaaaaaaagaaggccctcaccagatgtggctgcttgactttggaattcccaccctccagaactgtaagaaataaatttttaaaaataaagtacccagcccctcaggtattctattgcaacacagaatggactaagacagtgtttatatgtcaaaatctattttcctgtgtttaaactgtcttccttctccttgcagagggaatataaccttagccttttggagtgataatttcatgtttgtctgaagtagcttcttctcacattttctttttttttttttttatgttcaaaatgcttttatttctaggaatttagttttatttttaattttttaattattatactttaagttttagggtacatttgcacaacgtgcaggtttgttacatatgtatacatgtgccatgttggtgtgctgcacccattaactcgtcatttagcattaggtatatctcctaatgctatccctcccccctccccccaccccacaacagtccccggtgtgtaatgttcctctttctgtgtccatgtgttctcattgttcaattcccacctatgagtgagaacatgtggtgtttggttttttgtccttgccatagtttgctgagaatgatggtttccagcttcatccatgtctctacgaaggacatgaattcatcaatttttatggctgcatagtattccatggtgtatatgtgccacattttcttaatccagtctatcattgttggacatttggcttggttccaagtctttgctattgtgaatggtgccacaataaacatatgtgtgcatgtgtctttatagcagcatgatttataatcctttgggtatatacccagtaatggaatggccgggtcaaatggtatttctaattctagatcactgaggaatcgccacaccagcttccacaatggttgaagtagtttacagtcccaccaacagtgtaaaagtgttcctatttctccacatcctctccagcacctgttgtttcctgactttttaatgatcgccattctaactggtgtgagatggtatctcattgtcttctcacactttcctgctgtccatttcattctctttttcctcacctctcttggaaagctttaaagattaactaatcaaaaaatttttcagttgtatgtgcacagtctaggtaaatccagtcctaaaagaaatagaaatgcctaaaatgctaaaagaaacagaaaatcatatatatatacgtatatacatgtatatcaagatcagcttgggtaacatgtgagaccctgtctatacaaaaaaaaatacatgtatatacgtatatatatatagtgtctgtacatataggcactaaaaagtatatttatgtaatagcctttgctcttccagttagaagaaaagatctatcacgcctgtagtcccagcactttgggaggccgaggagggcggatcacgaggtcaggagatcgagaccatcctggctaacacggggaaaccccgtctctactaaaaaaaatacaaaaaaattagccaggcatggtggcgggtgcctgtaatcccggctactcaggaggctgaggcaggagaatcgcttgaacccaggaggtggaggttgctgtgagccgagattttgccactgcactgcagcctgggcaacaagagcaaaaactccatttcaaaaaaaaaaaaaaggtcttagttccaagacaaaagaagagcttttggcatgattcagttaaattttttattcactcatgtaaaaatgatgccagcgtgatattttggtttgtacaagaacagggttaattctctttctctctctctctctctctgagacagggtcccactctgtcaccccatctggactgcagtggcatgatcatggttcactgcagcctcaaccttctgggctcaagagatcctcctctctcagcctcccaagtagctgggaccccaggcacacaccaccatgcccagccaattttttgttgttgttgtatagacagggtctcacatgttacccaggctgatcttgagctcctgggctcaagcagttctcccaccttggcctcccaaagtgttgtgattacagacatgaaccactcactgctcctggccctcatgatttaagccttctcaatgtatttatgttgatcttatgagttaagtaaattgtgatggttttcataaattgtttaaatgaaaattatacacaggcactccttgttttattacacctcactttattgctcttcacagatattgcatttcttacaaattgaagatgtgtggcaaccctgtgttgagcaagtgttttttgtttgtttgtttgtttgtttttgcagtggagtcttgctcaggaggctgaggcaggagaatcacttgaatccaggaggcagaggttacagtgagccaagatcgcatcactgcactccagcctgggcaacagagcgagactctgtctcaaaagaaaaaaaaaaactggaacagcctgattgctgatatggagaaagttttagtggcctgaatagatcaaaacagccacaacagctctaaatctcttcattactatgaagactgagagggattaggaagctgcaggagaaaaatttgaaggtagcagaggctagttcatgagatttaaggaaatgagccatctgcagaacataaaagtgcaagatgaagcagcaagtgctgtgtagaagctgcagcaagttatccagaagatctagtaagataattgatgaagatggtttactaaacaacagatttccaatgtagacagaacagccttctattggaagaagatgccatctaggaattttatagctagagaggagaagtcaaagctttgaaggacaggttgactctcttgtcagggactaatgcagctggtctggtgactttaagttgaagccaatgctcattaaccattttgaaagtcctagggccctgaggaattatgctaaatccattctgcctgtcccctattaatggaacaaaaaagcctgaatggccacatgtctgtttatagcatggttcatggaatattttaagcccactgttgagacctagtgctcagaaaaagagattcctttcaaaatattatgacagttcctctggtcatccaagagctctaatggagatgtacaaggaaattaatgctgttttcctgcctactaatgcagtatctgttcttcagcccataagccaaggagtaatttcaattttcaagtcttcctgcagttgacccttgaacattgtgggggttaggggtgccaaccccaacacagttgaaaatccatatataactatttttcttttgtagagataaggtcttaatatgttgcctgggctggtcttgtactcctggcctcaagcaatcctcccacctcagcctttttctttttttttttttttttttgacagagcctcgatctgtcacccaggctggagtgcagtggtgtgatctcagctcactgcaacctccgcctcctgggttcaagtgcttctcttgctccagcctcccaaatagctgggattacaggtgtccgccaccacacccagctaattttagtatttttaatagagatggggtttcaccatgttggccaggctggtcttgaactctgaccacaagtgatctgcccacctctgcctttcaaagtactgggattacaggtgtgagccactgcccctggccttggcctcatataacttttgactccccccaaacttaactaccaatagcctactgtgaaccagaagccttaccaataacagaaacagtcaattaacacatactctgcatgttttatatattatatactgtagtcttacaacaaagtaaagtagagaaaagaaaatgttattaggaaaatcataggaagagaaaatatatttatggtactgtactgtattatgtataccataagtttatgtcgtatgtttataagatgaatcatctgtctgaaatggtgggcagccacagctgcagaccccaatccacattacatatcaagcagttgaacttttttttgtaatgtcatgactttcccctgcttcttagaagcacttccagcatgactagtggcacttcacgtgggtcccgtggtgttatacaaggcttacagtattgcactaaacacaataaagaacacaggagaaccacaagagatcactttttactgtaatacataatttactggagagataaactgctcatgtggagatgattagcatcacatagcatttaaaaaattattttttctgctgcactttaaaaattcttttactttttttttttattattattttgttgatgttgagatggagtcttgctctgtcacccaggcaggagtgcggtggcacgatcttggctcactgcaagctctgcctcccgggttcacgccattctcctgcctcagcctcctgagtaagctgggactacaggcgcccgccacaacgcccggctaatttttttgtattttttttagtagaaacaggatttcctcatgttagccaggatggtctcaatctcctgaccttgtgatccgccctcctcagcctcccaaagtgctgggattacaggcgtgagccactgtgcccggcctgctaattttttaattttaaattattatgggtgtattagtccattttcatattgctatgaagagatacttgagactcggtaatttataaagaaaaagaggtttaatagattcacagttccacatgtctggggaggcctcaccatcatgacagaaggcgaaggaggagcaaagacacgtcttacatggtggcaggcaagagagtgtgtgcaggggaactgccctttataaaactatcagagctcatgagacttattcactatcatgggaaccgcatgggaccatcttggttcactgcaacctccacctcccaggttcaagcgattcttgtgcctcagcctcccaagtagcggggattacaggtgcctgccaccatgcctggctagttattgtatttttagtagagatggggtttcaccatgttggccaggctagtctcgaactcctgacctcaggtgatccacttgccttggcctcccaaagtgctgggattagaggtgtgagccaaatttttcttgagttacaaaagaagaccatagagagtcaaaggtaacaggatgaagataaggaagatcagataaagaaaactttaattaaaagggtattaaagacaataacaggcaatatgaataacagaacaaagggtaggaaaacgggtaatgcacagccatagaaatgaacaaaatcatgtcctttgcagcaacatggatgcagctgaaggccattatcctaagtgaattaacacagaaacagaaaacctaatatcatatgttcttacttgtaagtaggagctaaacattgagtacacatggacataaagatgagaacaatagaagctgggaactgcagaggggaggaagggaggagaaagggctgaaaaacttgctattgttccctacttgggcgatgtgatcagcagaagcccaatcttcagcatcacacaacatgtcctggtaacctctgcatataaaattaaattaaattgaaaaaaaggaaaagggccaggtgtggtggctcacatctgtgatcccagcactttgggaggctgaggcatgaaaattttttgaggccagaagttcaagaccagcctaggcaacacagcaagaccctgtctctacaaaaaaaaaaaaattttaaattggctaggtgtggtgatgtatgcctgtatgtctaactactcaagaggctgaggtgggaaaaaattgcttgagcccaggagatcgaggctacagagagctatgaccaccactgcactccaaactgggcgacagagtgagatgaacccatcacccccctaccataaaaaagcagaagaagaaaggaagaaaataaaaaaggtaccgagtaatcaaataactaatcttgttctgttgtattccgcaggagaaggtgacatatgtcttttcatttgggaaatgtgaatccaaggatcaacaaacaagttttattattgtgtcagttacctgttaagatactttccttggccaggcttggtggccgacatctgtgatttcagcactttgcaaggctgaggtgggtggatcacttgagaccaggagctcaagaccagcctgggcaacaaagggagacctcgcttctaaaaaaattaaaaagattagccgggcattgtggtgtgcacctatggttccagctacttgagagactgaagcaggaggatcctttgagctcgtgaggtagaggccacagtgagccttgatcatgccattgcactccatcctaggcaaaagagcaagaccccatctcttaaaaaataaataatactttaaattttagaatacattgcatgaaacttaccatcttggcttttttttttttttttgagacagagtcctgctctgtcgcccaggctggagtgcagtggcgtgatatgggctcactgcaaactccacttcccagattcaagcaattcttatgcctcagtctgctgagtagctgagactacaggcacacatcaccacgcccagctaatttttgtatttttagtagggacggggattcaccatgttggccaggctggtctcgaactcccgacctcaggtgatccgcctgtctcggcctcccaaagtgctaggattacaagcatgagcggctgtacctggcccatcttggcaatttctttttttgaaatggagtttcgctcttgtcaccaaggctggtgtcaagtagctgggattacaggcgcccgccatcatgcccggctaatttttgttttgttttgttttgtttttgagatgaagtttcgctcttgttgtctaggctggagcgcaatggcgtgatcttggctcactgcaacctctgcctcccaggttcaagcgattctcctgcctcagcctcccgagtagctgggactacaggcgcccgccaccacacctggctaatttttgtatgtatagtagagacagggtttcaccatgttgaccaggctggtcttgaacttctgacctcaggtgttccacccgcctcggcctcccaaagtgctgggattacaggtgtaagccaccgtgcccggcctaatttttgttttttttttaatagaggtggggtttcaccatgttggccaggctggtctcaacctcctgacatcaggtgatccacctgccttggcctcccaaagtgctgagattacaggcgtgagccactgcacccagccaacatcaacaattttatagaacaccacgacagagacaaggccactctatgactgtggtggatcagacaaaaacaaagccactgtgtactcatgatgtctgaacacagacaaaaacaagaacattgtccaaactatttagtcctgctcctttctcccacctttcagttgaaaattacggtactcagacatagaattacctcttcctggccgggtgcggtggctcatgcctgtaatcccagcactttgggaagccaaggcaggcagaccacgaggtcaggagatcgagaccatcctggctaacacagtgaaaccccgtctctactaaaaatacaaaaaaaattagctgggtgtggtggcgggcacctgtagtcccagctactcgggaggctgaggcaggagaatggcatgaacctgagaggcggagcttgcagtgagccaagatcgcgctgttgcactccagcctggagacagagcgagactccatctaaaaaaaaaaaaaaaaaagaattaccccttccttcctgatgcatccaaaccagagcaaaccctcttgcctcaaatcctctcctgaaacataacacgagcataagtcctacaataagtctttttttttttttttttttaattagacacgtggggtttcactatgttgcccaggctggtcttgaactcctgggcctaagcgatcttcctgccttggcattccatattgctgggcttacaggcgggagccaccatgcccagtctaagtcatcttcaacacctctttctgagatgccttagagttccccatattatgtgggtctgcctcattgctatgagtccgtaaaactgactttgttttttgttttgggttgtttttttttttttttttttagacatggtctcattctcttgcccaggctggagtacagtagtgcaatcatgacctactgcagcctcaacctcccaggctcaggtgattctcccacctcagcccccttgagtagctaggactacaggcacatgccaccacaccccactaattttttgtattttttgtagagatggagtttcatcatgttgcccaggctagtctcaaacccctatgttcaagcaatcctcccaccttagcctcccaaagagctgggattacatgcatgaaccaccacactcagtcccccaacgttgttttaaaactttcttttaggtgtgttcttggtggcccttaacagaaggacattgacactggaatctggatgtttgtttgttttggagacaggatcttgctctgtcacccaggctggagtgcagtggcacaatctcggctcactgcaacctctgcctcctgggttcaagcgaatctcgtgcctcagcctcccaagtagctgggattacaggtgcctgccaccacacctggctaatttttgtatttttagtagagacagggattcaccatattggccaggctggtcttgaactcctggcctcacgtgatccacccacctcggcctcccatagtgctgggattataggtgtgagtcactgcacccggcctggatttttttttttcagtgaaagatactgattttttttaagttgactcaaagcaagttttaaacactctgtgtccacttcatgttgctatcacagaatatcacagtctgcgtagtttaggaacaatagacatttatttggcttatggttctagaggctgtgaagtccaagatacaggagctgcctctggtgagacatcatcacgtggcaagagagcatgagagagagaaagagggggctgaatttgcttttataacaaacccattcctgaaataatggcattaatccattgacctaattgcctcttaaggatctcacctctcaacagtattacatcagggattaactttccaacacctgagatttgagggactcattcaaaccatagtactctgaaattggatatataggtctatgggtgagattcccactgagggttgccagtttgcaacctttcagttgaatggtctccctcctggatgtcaaggttaatactgctatgaacagctattatgcacctaagttgaaccagggagagaacacatccttccgcatgtactattttatttaatgttattttctactaagtcattcagaactctctggactctcttcatgctgtgtaatttgcaaggttgcctgctgcatgtttggttataaatgaggtcaaatcccaattttgcaggaggacgtggatgtatgcccattcccttcacactgtgagccagtagccatgggaactataatcaagtacacaataactcccccatgaacaaatcctcagggaacaagcttcaattgaatgaaactggcttgaccacagaggaatctgggggactttctgagcttcgcggacttgtgccgcctcctgactttaagctggctctggaggaggaggaagtggaggtatctcaggtatggacctctttctggaagctgggacttggaccaggcaaagaaaggaggcggtggggaaaattcccccagagaaggcaggagtgggccctgcataccaggtccccaggtctctgagagctttactagttctgggagtgtgtggatcaagcctaaagtctagaaggaattctagcatcacccagggcgttggctggaatatctttaaggacccttccagccctggaatcatagcagcaaaggacccaattgtatgacagctgctttggccagtgaagatggaaagaccaggaaaagctttaggctaagcaatggagttcacaccccgctaattcacctcccttgcggcatccctgacatttcccacacaatatgtccttcattctgttctccaaaaagccattgccttcctctaactgactgagatgagccctggaaaccctgatgcccaccagacccctgcctttcctcttctctgctgttggccaaggtttctgcctcagttgccctgtctgacaatacagtttccctaggactggagctagccctggcatcccagaatccccaacaggtgctagcccctggagtcaggactgtcttcctgtgtccctgtgcttgctgcagaataaactgattacttttaactaccattctgaatatagtcactaccaggaaccgctgactacctgtgacataccatctagcatggtaccacagcacctggcccagcatcttgggaggccaaggtgggaggactgcttgagggcaggagtttgagatcaacctgggcaactacatagtgagaccccacctctacaaaaaatttcaaaattagccgagtgtgattgcacatgcctgtagtcccagctacttgggaggctgaggcaggaggatggattgagcacaggaagtggaggctgcagtgagctatgattgcaccactgcactccagcctgggagacaaagggagattccgtacataaataaacaaataaataaaaaacaaaggagatggatttttttctacaagagagttacatgcagggtgctaggtactataggtggagacttgccgaggttcagtgggaatgggagctcaatcctgagagtgggggaaggcattacagaggctgtgacctttgagactggtcttgaagaaagagaaaatgtgtacaaggcagaaagaagggagaaagttacccgaagagagaactgcaccagccaaaaatatggaggtatggagtaggtagaattgtgagacatttatgtgactggagtgaaaaatgagagatgatgctggaaaggagagttaaggccaggttttgaaggatctcttaaaaaaataataggctggcgagattgtgccactgcactccagcctgggcgacagagcaagactccgtctcaaaaataataataataatagtaataataggctgggcacagtggttcacacctgtaatcccagcgctttgggaagccaaagcgggcagatcactcaagatcaggagttcaagaccagcctggccaacacggcaaaaccctgtctctactaaaaatacaaaaattagctgggcgtggtggtgtgcacctgtagtcccagctactagggaggctgaggcagaagaattgcttgaacccgggaggcgaaggttgcagtgagcagagattctgccactgcactccagcctgggtgacagagcaagactctgtctcaaaaaattaataatgataataatacattaattttgagataagatcttgctctgtcgcccaggctggagtgcagtgatataatcacagttcactgcagcctcaagctcctgggcttaagcgatcctcctgcctcagcgtcccaaggtgctgggactacaaccatatgacactgacggagcaagagcactgtcatctgggacaaacaccgcccctttaagttacagctccctttctagcctcatgcatttcaaggaaatcacttctcttctaactacaagcagacagaaagagcagacaggaaaacgcagataagacagtttgggcatagagggaggtgggggcaaagtctcttgggtaactgccaaacttcaccctcatacaacgggccccagtaaaacagtgggccttaggccgggcgtggtggctcatgtctgtaatcccagcactttgggaggctgaggtgggcagatcacgaggtcaggagttcgagaccagcctgatcaacacggtgaaaccccatctctattaaaaatacaaaaattagccgggcatggtggcgcgcgcctgtaatcccagctactcaggaggctgaggcaggataatcccttgaacctgggaggcagaggttgcagtgagcctagatcacgccactgcattccagcctggacaacagagagagattgtctcaaaacaaacaaacaaaaaaataatgggccttaataagcacatttctttcccttcagttgcactaagatagggaagttaaaagcagactcaggggatatgcctatagctgcagaaaaaagataagcacaagataagcacaacaaagagacacagaagcagtccaagcctctgataaactctcccaccctgaatccttacaaactctttgtaagaaagggtggctctgacctaacttggccagctgccaagtttattattcaaaataaacctgtccctgatgactgtcaaaccacccttcatgtttctctcctctttctttaattcttacagccaccacgcctggctaatttttttgaatttcactggaggtcttgctgtgttgcccaggctggacttgaactcctgagctcaagtgatcctctcgcctcagcctccgagtgttgggattgctggaggatcatatctgtttccaaaggtggagctttctgctggaggcagcagagttcttcaggcagagcagctgagtcttgaggttgctcttttaggaaacaaactcaggaggcgctgtggaagatgcattgaatggagtaggaggtggaggcagcgagaagggtgaggagacactgctgagccctgatgagagacaaagaatgtctgaaggaagcaaagggaatggagaggaggggaaggctttgggaagactgtgatgcatggaatgcgtgggataagggcagagggtggagtccaggctgactcagaggtttattgcctgggagactgggtagatgattacactgtaacctgagatgaagatacagtaagaggagtttatatgaagaaaaagtaggccaggcgcagtggctcacgcccataatcccagcactttgggaggctgaggcgtgtgaatcaccttagccccagagttccagatcagcctgagcaacatagagaaatctcatctctactaaaattcaaaacaattagctaggtgttgtggtgcagacctgtagtcccagctacttgggagtctgagatgggagaaccgcttgggcccaggaggtcgaggctgcagtgagtcatgatcgtgctactgcactccagcttgggcgacagagcaagacactgtctcaaaaggaaaaaacagaaaaagtaataagctcagtttttaaacagaaattgtagtagaatacaatgtaaaatttaccatttaaccattttacagtgtacaattcagtggcattaagtaaattcacaatgtttgaaagcatcaccttgatctagctccaaaacattctcatcaccccaaaggaaacccccaaatccattaggcagtgattctctattcccctgtgtgcccagcccctggcagtccctaatctccctgtagatttgcctgttctggacatttcatatgcatggaatcatacgatatgtgactatagtttatggctggccactttcacttagcacaatgttttctttctttcttttttttttttttttttgagacggagtctcgctctgtcacccaggctggagtgcagtggcacgatctcggctcactgcaagctccgcctctcggggttcacgctattctcctgcctcagcagagtagctgggactacaggcgcccgccaccacgcccggctaattttttgtatttttagtagagatggggtttcaccgtgttagccaggatggtctcaatctcctgacctcgtgatccgcctgcctcggcctccctaagtgctgggattacaggcgtgagccactgtgcccagccagcacaatgttttcaaggttcatccatgttatagtatgtatcagaattcttttttttggagactcagagccccattttttttggagactcagagtctcattctatcacccaggctggagtgcagtggtgcaatcttggctcactgcaacctctgcctcccaggttcaagtgattctcctgcctcccgagtagctgggataataggcaaacgccaccatacccagctaatttttgtatttttagtagagaaagggtttcgccatgttggtcaggctggtctcgaactcctgacctcaagtgatctatctgccttggcctcccaaagtgccgggattataggcgtgatccaccgcgcctggccccttacccatttttcaattggtcaattttctttttcttattgaattgtaagagttatttctatgttttaaatacaagtactttatcagatgtaagatttgcaaatactttttcccattcggtgagctgtcttttcaccttgtggctggtattcttttttttttttttttttttgagacagagtcttgctctgttgcccaggctggagtacagtggcaggatctcggctcactgcgagctccacctcccgggttcacgccattctcctgcctcagcctcctgagtagctgggactacaggcgcccgccaccatgcccggctaattttttgtatttttttttagtacagatggggtttcacggtgttagccaggatgctctctatctcctgacctcgtgatccacccgccttggcctcccaaagtgctgggattacaggcgtgagccaccgcgcccggccttgtgggtggtattctttgaaacacaaaactttttattttgatgaagtcccctttatctatttttacttttgttacctgtgcttttggtatcatatctaagaaatcattgccaaatacaatatgatgaagattttcccctatgttttattctaggatttttatggtttttgcacttaagtttagatctttgatccattttgagttaattttttgtatgtgagctaagctttctatgtggggtacagaaaagggctaacctcattattttgcatgtttcccccaccccctgcccaccaacatttgtcaaaaatacgaatcctttcccccattgaatagtctaaacaactattttcaacaagggaaaatagttgaaaatcaattgttgaaaatcaattaaccatatatgtgaggatttatttctgggttctctattctactccatttgtttctctatctacccttaggtcagtatcacactgggttttttcttttgtttgttttaactttttaaatttcttgtttttaatttttgtgggtacgtagtaggcatatatatttatagggtacaggagatactttgatagaggcatgcaacgcataataatcacatcatgataaatggggtatctatcccctcaagcatttatcctttgtgttacaaataacccagttaaattctttcagttattttaaaatatacaattaaattattattgactggcctggcgcagtggctcgtgctgtaatcccagcacttttggaggccgagatgggcggatcatttgaggccaggagttcaagaccagcctgaccaacatggtgaaactccatctgtactaaaaagacaaaaaaagttagccaggcctcaggcgcctgtagtccccactactcaggaggctgagacaggagaatggcgtgaacccaggaggcagagcttgcagtgagctgagatcgtgccactgcactctagcctgggtgacagagcgagactccatctcaaaaaaaaaaaaaaagttagccaggcctaggggtgcacgcccatagtcccagctacttgagaggctgaggcaggggaattgcttgaacctgggaggcggaggttgcagcaagccaagatcatgccactgcactccaccctggttgacagagctagactccgtctcaaaaaaaaaaaaagaatggcctggcgctgtggctcatgcctgtaatcccagcactttgggaggccgaggcggggggcagatcatgagatcaggagttcgagaccagcctgaccaacatagggaaacccgtctctactaaaaatacaaaaattagccaggcatggtggtacatgcctgtagtcccagctactcaggaagctgaggcaggagaatcgcttgaacctgggaagcagaggttgcagtgagccaagatggcaccactgtactccagcctgggcaacagagcaagactctgtctcaaaaaaaaaaaaaaaaagaagaatcatattgctaaaaaaaatagtttttcattctgtctatatgtcataagtgagatgacttgaactccctaagcatatgtgtccattatttccaccattaaaatgaattaaggtgcttggcatgactgccccctgtttattagttctaatagttttttagtggagtctatgttttttctaaatataagatcttatcatctgcaaacaagaataatttttacttcttcctttccaatttggacgccctttgtttctttctcttgtctaattgttctagctaggtcttccagtactatgctgaataacagtggtgaaagtgggcatccttgtcatgttccagatcttagaggaaagtctttcgggttttcctcattcagtatgatactagctgtgggtctgtcatatatggtttttataatgttgaggtatgtttcttctacacccagttttttgagggtttttattatgaagtagtgttgaattttatcaaatgctttttcagcatcaattgaaatgatcatatggtttttgtctttcgttttgttgatatgatgtaccacattaattgatttgtgtatgttgaaccatccttgcatccctgggagaaattccacttcgtcatgatgatctttttttttttctgaggtggagtcttgctctgtcacctaggctagagggcaatggcacaatctcagctcactgcagcccctgcctcctgagttcaagtgattctcctgcctcagcctccccaggagctgggactacaggtacatgccaccacacccagctaattttttttattgtagagtcaacattttgccatttacccaggcaaaatgagtaacattgtgacctcctgggttaaagtgatcttcctgccttagcctatcaaagtattgggattataggcatgagctaccatgcccagccaaatactatcttattacccattattttaaactgataactgatgacaacttttttttttttttgagacagagtctcgctctgtcgcccaggctggagtgcagtggcacgatcttggctcactgcaagctccgcctcccgggttcgtgccattctcctgcctcagcctcccaagtagctgggactacaggcacccgccaccgtgcccaactaattttttgtatttttagtagtgacggggtttcactgtgttagccaggatgatctcgatctcctgacctcgtgatccacccgcctcggcctcccaaagtgctgggattacaggcgtgagccaccacgcccggcaaactgatgacaacttaacactggttgcataaacaaacaaacaagcaaaatgaaaaaaaaaataataaaaactctacactttaacttcctccccccctgctttttttttttttttttttgagatggagtctcactctgtcgcccaggatggagtgcagtggcgctatctcagctcactgcaacctctgccttccatggttcaagcgattctcctgtctcagcctcctgagtagctgggactacaggtgcacaccaccacacctggctaatttttgtatttttagtagagacggagtttcaccatattggttaggcttgtcttgaactccagaccttgtgatccacccgcctcagcctcccaaagtgccgggattacaggcatgagccaccgtgtccagcccccactgctttttaatgtggttccctttatgtcttattgtactatgccttgaaatgttgtagttattgtttttttattggttcattgtttagcttttctacttaagagtagttggccaggcgcagtggctcatgcttgtaatcccagcactttgggaggcctaggtgggtggatcacctgaagtcgggagttcaagaccagcctgaccaacacggagaaaccctgtctctactaaaaatacaaaattagctgggtgtggtgatacatgcctataatcccagctactcgggagactgaggcaggagaatctcttgaacccgggaggaggaggttgcagggagtcgagatcgcaccattgcactccagcctgggcaacaagagtgaaactccatctcaaaaaacaaaacaaaacaaaacaaaaacagataatggtagtttatataccaaaattacagtgttataataccctgtatttttctgtgtgcttgctattaccagtgaattttgtaccttcaaatgatttcttattgctcatgaacatccttttctttcagattgaagaactccccttagcatttctcgtaggacaggtctggtgttgatgaaacccttcattttcgtttgtctgggcaagtctttatttatccttcatgtttgaagaatatttttaccagacatactattctagggtaatttttttttcttttagcactttcaatgtcatgccattctttcctggcctgtaaggtttccactgaaaagtctgctgccagatgggaattggagctccattgtgtgtttttttgtttgttgtttgtttgtttgtttttctgagatggagtctcgctctgtcgcccaggctggagtgcagtggcgggatctcagcttactgcaaacttcacctcccaggttcaagcgattctcctgcctcagcctcctgagtaactgggactacagacatgcaccaatacacatgtgtgtgtgtgtgcgtgtgcgcgtgtgtgtgtatttttagtagagacggggtttcaccatgctggccaggctggtcgtgaacttctgacctcaggtgatccacccacctcagcttcccaaagtgctgggattacaggcgtgagccaccacgccttctaatgcattctttagtatgtcaattgcattttccaactctagaatttctgcttatttttagttatttcaatctctttgttaaatttattgatagaattctgaattccttctctgtgttattgtgaatttctttgagtttcctcaaaacgtcttttttgaattctctgtctgaaaagtcccatctgtgtttctccaggattagtccctggtggcttctttggttcatttggtgaggtcatgttttcctggatggtcttgatgcttgtcaatgttcatcagtgtctgcacattgaagagttaggtatttattgtagcctttgcagtctgggcttgtttgtgcccatcttttttgggaaggctttccaggtatccaaaaagacttgagctccaagcccaataacactgtggttcttgtggactcatataagtaccaccttggtggtcctagataagatccagatgaattctctgattactaggcagagactcttgttctctttccttactgtctcccaaataaatggagtctctgtctctttgctgagcttcctggagctaggggtggggtgatgcaagccttcttatgaccaccaccattaggactgtgctgggtcatacctgaagccagcacagcagtgggtctcacccaaggcccactgtaaccactacccgaataccatctatgttcactcaaggccctagggctctacaatcagcagctagggccaccagtctgatttctatctttcccttcagggcagcgagttcctccaggtcctgggagggtccagagataatgtctgggagccacggattagagtcaaaaaccttagaaatctacctggtgttctattctactgcagctaagctgggactcaaaccacaagacaaagtgcctcccactctaccttcccctttccatggacagaggacagaggagcctctcccagtggccactaccaccactggcctgcagagagttctgaacactcacttaaagcccaaggcctcttcaagtcaacttgtggtgaatgctctcaggcctgggactcaccctttaggacagtgggtccccctctggcccacagcaggtccaaaaatgttgtccaagagcttaggtctggactcggggaccccaaaaatctgcttggtaccctaccccactgtgtccgagctggtatctaaggggcaagacaaagttccctttactcttctctccacttttctcaagcagtagtctttcaccagggccaccacagctggtaatgtgctgggccctacctgaagccagcacaactcagactcttatccaaggtccacagatactacctgggtattgctgttggctattcagggaccaagggctccttagtcagcaggtgataagcccttccaggactgcgtcctcccttcaggacagcaggctcccttctggcccagcgcatgtctaaaaatgtcatccaggagctagggcctggaatgagggcctcatgactgcctggtgctctatcctattgcggctgatctggtatccaagatgcaagacaaagtcctctttactctttgctttcctctcctcaaacacaaggaaggagttactttcgttgctgtgagctatgccgcctggaatcgggggaagggtggtgcatgcactcctttagctgccccaactactgcctagctaggtcatgtgccatcctagtccactggctctaaggccagcccagcactaggacttgcctagaagttgcagtccttgtatcctaaaatgcctttcaaatttacctaggaccccagagcactttagcctgcagtggcaaggcttgccgcaacttgagttctgaccactaggatggacaattcccctctggttcgggctgatacaaatgctccctccttgggcaggcactggctgagtccagcatggctttgctctccactgtgacagggcagcactgagttcactggcaagtccctcagttcaatgccaagtcccccagtccatgtgctctctctcctccaagtgcacagtttctctctgtgccatgcagctactgctagggggttggggaggggtggtgtcagcgattcaagacagtgtttcctgcccgggcacggtggctcacacctgtaatcccaacactttgggaggccaaggcaggcggatcacttgaggtcaggccaacatggtgaaatcccgtctcactgaaaatacaaaaacccggcgggcgtggtggcacatgcctgtagtcccagctactagggaggctgaggcaggagaatcgcttgaacccgggaggcagaggtttcagtgagccgagactgcaccattgcactccagcctaggcaacagacaaagggagacttcatctcaaaaaaaaaaaaaaaaaaaaaaaggctgtctttcctaccctcttcagtgcctctttcagtgatatgaagttaaaatcagctactgtgaccactcacctgatttttggttcttatgatggttctgaggaggcttctattctgccatcttgctctgacttcccactacattgtgttttgtttgtttgtttgtttttgacattcactctgtcacctaggccggagtgcagtggccaaatctgggctcactacaacctctgtctcccaggttcaagcaattctcgtgcctcagcctcctgagtacctgggattacaggcgcttgcccccactccggctaaatttttgtatttttagatggggtctcaccatgttgcccaggatggtattgaactcctggcctcaagcgatcctcccgcctcagcctcccaaagtgctgggattacaggcatgagccaccacgcttggcccccctacagtttttgtttggttgtttgtttgagacagagtctagctctatcccccaggctggagtgcagtggcgaaatcttgtctcactgcaacctccgcctccggggttcaagcgattctcctgcctcagcctaccgagtagctgggattataagcactcgccacccagttaatttttgtatttttagtagagatggggtttcgccatgttgaccaggctggtctccaactcctgacctcaggtgatccacccaccttggcctcccaaagtgctgggattacaggcgtgagccactgcacccagcccctacactgttttgattatgatagctttgtagtaagttttaaaatcaggaaattgagtccttcaactttttttcaagaccattttggtattcagggtcccttgagattctgtatgaattttaggatgggtttttctgttccactgccctccagcctgggtgacagagcgagactccatctcaaaaacaaaaaaacaaaaaaaaaaatcatagggatttgatatgatttgttaggaatttgcattgaaactgcagatcgctttgggtagtattgccatcttaacactattaagtccttcaatccatgaatgtgggatgttttctcttttgggggtcttctttaatttatttcagcagtatattgtaattttcagtgtacaaatctttgagctccttggttaaatttctaagtattttattattttgatgctattgcaaaggaagttattatttaaatttccttttcaaattgtttgctgcaagtgtataaaatctgagttgattttatgtcctgcaactttgctgaacttaattctaaaatttttgtgtggatttcttatgatttttctatatataattatataatctgtgaaaagagatccttttacttcttcctttccaatgtggaagtcttttgtttcttcttggcgaattgctttgcctagaacttctagtactttgttgaatagaagtggtgagagcaggcatccttgtcttgttcctggtctgagggtacaagcttttagtctttccctgtagagtatgatgttagctgtggtttacggcctttatcatttggaggacattcctgtctatttctagtttattgagtgttttaatcatgaaaggggtttggctgggcgcagtggctcactcacgcctgtaatcccagcactttgggaggccgaggcaggcagatcacctgaggtcagaagttcgagaccagcctgaccaacatggagaaaccccatctctactgaaatacaaaaaaattagccgggtgtggtggcgcttccctataatcccagctactccagaggctgaggcaggagaattgtttgaacctgggaggcagaggctgtggtgagccgagatcacgccattgcactccagcctgggcaacaagagtgaaactccgtctcaaaataaataaataaataaataaataaataaataaataaataaataaataaaatcatgaaagggtgttcattttttcaaagccttttctgcatcaattgagatgaccatgtgttttctccccggttcattctattaatgtggtgtattacattgatttttttcttttttttaagacagagtcttgctctgtcgcccaggctggagtgcagtggcttgatctcagctcactgcaacatctgcctcccaggttcaagtgattctcttgcctcagcctcccaagtaactggtattataggcacctgccatcatgcatggctaatttttgtatttttagtagagacggggtttcaccatgttgggcaggcttctctcaaactcctgacctcaggtggtctggctgcctcggcctcccaaagtgctgggattacaggtgtgagccactgcacccagccacactttgcatattttgaagtgcatctatttacttagcattcgtgacttgaataatttcaccaaatgaataattttgggtagtttgaaattcgttcttccaattgttacaccttgtttggtgtttgtaataaacacgtaaaggtaaaaaaaaacagtttttctgtattctgccaatcatacttttatataataaatcatccatttttttcccataaaaaaaaagaaagttattgcttaatgttacagaatttctgtttggagtgatgaaaaagttttggaaatagtagtgacagttgcacaaaattgtgaatgtaattaataccactgaactgtgcacttaaaaatagctaaaatggccaggtgcagtggctcatgtctgtaatcccagcacttccggaggccaaggcaggtggatcacctgaggtcaggagttcaagaccagcctggccaatacggtgaaacctcgtctctactaaaaatacaaaaaattagccaggtgtagtggcagacacctgtaatcccagttacttgggaggctgaggcaggagaatcacttgaactcaggaagtggaggttgcagtgagccaagattgcaccattgcattccagcctgggcaacagagcgagatctgtctcaaaaaaaaaaaaaaaaagctaaaatggcaagttttatattatatatgttgtttaccacacacacacacacaaatactaagaaaaaaatcaggcagatcctcttctaacaacacttacagtctattaagtgaatctgggcattttaaagaaaaaaataactatttttggttacggaatcaggatagtagttgcctatggacacgggcagtggggactgactagaaagggaagggaaggaagttcttggacctagaagtgttttatgtcttgattggggtgtttagataggcattacatttgtcaaaactcatgaaattttatactttaagatctgtgcatttcactctatgtaaattttaccttagtaaaaaacaaaacaggctgggcgtggtggctcacgcctgtaatcccagcactttgggaagccaaggtgggtggatcacttgtagtcagaggtacgagaccagcctagcaacatggtgaaaccccatttctactaaaaatacaaaagaaattagctgggtgtggtggcaagcgcctgttatcccagctacttaggaggttgaggcaggagaatcgcttgaacctgggagctggaggttgcagtgaactgagatggacccactgcactccagcctaggtgaccgagcgagactccatctcaaaacaaaacaaaacaaaaaatgttagcaacttctaatcccttgacagtttatatataccgcagtgattttctcccacttctcactcacgtgggatcttatcatacagaggttttaaattttaaacaattaaatttatcaaccttcttcatttatggtttctatatttgtgtgtcttgcttcagaaagtatctcttattccaggtaatcatattatcctatttttaaattctattttggaataaatatttcttattccaggcaatcatattattctattttttttctatatttttattgttctttcctgtgtgggacatgtagctggtgggctagctgcagaccacgggcaagtttgctaacattgctaagtcttggttttctcatccataaaatagggataataatttgctttgttattgacatgatttaataaagtaatatttatttgtttatgtatttattttagagacagggtcttactctgttacctaggctgaagtgcagtggcaatctcggttcattgcagctcaagtgatccttctgccttagcctccagagtggctgggactacaggtactgggactacaggatgggactacagagtggctgggcatccagctaacttaaaaatttttttgggctgggtgcagtggttcatgcctgcaatcccagcactttgggaggccgaagagggattaagaggtcaggaatttgagaccaacctggccaagatggtgaaaccccgtctctactgaaaatacaaaaattagccgggcgtggtggcaggcacctgcagtcccatcaggaggctgaggtgggagaatcgcttgaacccgggaggtggaggtggcagtgagccgagattgcgccattgcactccagcctgggctacaagagtgaaactccaccttaaaaaaaaaaaaaaaaagccgggcgcggtggctcacacctgtaatcccagcactttgggaggccgaggcgggcagatcacgaggtcatgagatcgagaccaccctggctaacatggtgaaaccctgtctctactaaaaaatacaaaaaattagctgggtgtggtggcaggcacctgtagtcccagctacttgggagactgaggcaggagaatggtgtgaacccaggaggcggagcttgcagtgagcagagatcatgccaccgcactccagcatgggcaacagagcgagactccgtctcaaaaaaaaatttttttttggccagtcacgatgtgtcacacctgtaatcctagcacttagggaggccaaggcgggtggatcacttgaggtcaggagtttgagaccagcctggccaacatggtgaaaccccgtctctactaaaaatacaaaaattagccagggacagtggcatgcctctgtaatcccagctactcaggagactgaggcaggagaatcacttgaacccaggagttggaggttgcagcgagccgagatcacaccacttcactccagtctgggcgacagagcaagactccatctcaaaaaaaaaaagtctagatggggccgggcagggtggctcacacctgtaatcccagcactttgggagtctgaggcgggtagacggcttgagctcaggagttcgagaccagactgcacaacatggtgagaccccgtctctactaaaaatacaaaaagagagaaaaaaaaatagcttggcatggtggtgcacacttgtggtcccagctacttgggcggatgaagtgggaggattgcttgagcatggtgaggagggaggttgcactgagccaagattgcgccactgcccaccagcctgggtgacagaccaagaccctgtctcaaaaaaaaaaagaaacaaaaaaaaggtggggctcactggctcacacctgtaatcccagcactttgggaagcttaaggtggatggatcacttgaggtcaggagttcgagaccagcctggatgacatggcaaaaccctgtctctactaaaaatacaaaaaaattagctgggcctggtgacgcacgcctgtagtcccagctactagggaggctgaggcaggacaattgtttgaactcaggaggcagaggttgccgtgagctgagatcgcaccactgcactccagcctgggtaaccagagtgaaactctgcctccaaaaaaaaaaaagaagaagaagaaaaaaggtttaggcaaacatgcacttttcctgttgcttttttttttttttttgagatggagtttcgctcttgttgtccaggctggagtgcaatggcgtgatctcggctcactgcaacctccgcctcctgggttcaagcgattctcctgcctcagcctcccaagtagctgagattacaggcatatgccaccacgcccgaataattttgtatttttagtagagatggggtttctccatgttggtcagactagtcttgaactcccaacctcaggtgatcctcccgcctcggcctcccaaagtgctggggttacaggcatgagccactgcgcccagcctgaacatgccagattgtagttccaggaggccagagatcatgaatactttgtccaccactatattcccagcccacagaatacacagcctggcagccaacagatgcttattgaatgaacgagcctcaacagggctttctcattcccacatgccatgctgtggtcaggcttaaatcataacccaacttctgccacctaatatatgtatgaccttggttaaattaaaccagcagtccccaacctttttggcactggggaccagtttcatggaagacaatttttccaccaggggaggaatggtttcgggatgattcaagcacattacatttattttgcactttatttctattattattacattataaggtataataaaataattatacaactcatcataaagtagaatcagtgggatccctgagtttgttttcctgcaactagatagtcccatctgatgttgatgggagacagtgagagatcatcaggcattagattctcataaggagcaacctagatccctcgcatgcgcagttcacaataggattcatgctcctatgataatctaatgccgctactgatctgacaggaagcagagctgaggcggtaatgcaggcaatggggagtagctgtaaatacagatgaagcttctctcaccagccattcacttcctgctgtgcggctcagttcctaacacgtcacggactggtactggccccacggcccaggggttggggacccctgacttaaactaagggccagctttccagaataacatccactttgagggcttgttgagtggattaagtcaaaatgttggtatacttggctggtgcggtggttcacacctgtaatcccagcacttcgtgagtctgaggcgggtggatcacctgaggtcaggaatttgagaccagcctggccaacatgatgaaaccccatctctactaaaaatacaaaaaattaggccgggcgcggtggctcacgcctataatcctagtactttgggaggccaaggcgggtggatcatttgaggtcaggagtttgagatcagcctggccaatatggtgaaaccctgtctctactaataagtacaaaaattagtcaggtgatagtggcgtgtgcctgtaatctcagttactcgggaggctgaggcaggagaatcccttgagcctgagaggcagaggttgaggtgagctgagattgggctgttgttgagttgtaggagttctttatatattatagatattaaccccttataagatatatgatttgatatttcctctcattctgttggttgccttttcactgtcctttcctttttttgtttttgttttttgtggggcagagttttgatcttttgcccaggctggagtgaagtggtgcaatctcagctcactgcaacctccactccccaggttcaagcgattctccagccttagcctccggagtagctgggattataggcgcccggcaccatgcctggctaattttgtacttttagtagagatggggtttcaccatgttggccaggctggtctcaaactcctgacctcaggtgatccacccgcctcggcctcccaaagtgctaggattacaggcttgagccaccgtgcccagcctgttgtgtccttcgatgcacagaaaagactcttttctctactgaacgcccacagcacccttgtcaaaaatcatttgactagtcagggcacagtggctcacgcctgtaatcccagcactttgggaggccgaggcgagaggactgcttgaggtcaggagttcgagacatgcctgggcaacatggcaaatggcaaaaccccgtctctacacacaatgcaaaagttagctgggcatggtgggtggcgtgtgactaccggctgtctcaactacccaggaggctaaggcgggaggatctcttgagcccaagacgtccagactgcagcgagctttgattgtgccactgaactccagcctgggcgatgacagagcaaggctctgtcaaaaaaaaaaaaaaaaaaaaaaaaaaatcggccgggtgtggtggttcacgcttgtaatcccagcactttggggggccgatgcgggcagaccacgaagtcaagagatcaagaccatcccggccaacatggtgaaacctcgtctctactaaaaatacaaaaattagctgggcgtggtggcgtgcgcctgtagtcccagctactcggaaggctgaggcagaagaatagcttgaatccgggaggcggaggttgcagtgagtcgagatcgcgccactacactccagcctggcgacagactgagaccccgtctcaaaaaaaaaaaaaatcatttgtatatgcgaaggttttgtgccacaaacttttgtggctgttgatacaaacgacatggcctctgccttaaggaagccacagtcgaattaaatagattccgtttcaagtagcatctgtcctgtgtgcttagtgggcactgggcccatgttttcccacattttaccctttaagcttctgatccaaccggtgagatagataggatgatcctctttagtagaggggtaagcttagtcccctgagagcgcggctatggcttatgcgagggtacggacagtcaggatttgaacccaaagttcctggctccatgtgtcatgctacctccagtcagatgttctcacctccaaaacttgggcagaagtgaactgagatgctctctactgagcaactcttcagctccagcatcctatacattaaggagtcactaaaagtcagggtccacgagaaaggtgcagatcggggtgcacagaagagcggagtccaaaacaccactcccagccccagtggacagagtcctcaagtggcagccctgcaactctgagcggatgccgagtcctcaccgggaacccgggcgcggctggtctgtgctattggcgcgggtaggggacgcacagcccaaaaatgcccgcgacaagcttctggggcagttctcgccagtctctctggagggagcctacgggttctgcgacgtttctcgcacttgctccctggcctcgctcccgtttccacccctcccacggaggttttcctttctggtggctccttccttgggtgtccctttggtacgcccccaccctggcggtgagctgcgaggctggcgcccgcgtggccactgcgcatgcggacccggccgcggggcggggccgcgcgaggaggagggtcggggacggaagcgcagagcacggaccccgccccctcgcggccccgctcgtgacgtcgcggggggcgccggcctccgcccggccccgaggggtaagagcgagcggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctgagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggtaagttccccacccccgtacccgctcttccttccaacctagacaggcttttgctgctaatctcatctcacccgtcttcttttgctcacaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggtgagatcagaggctgggtgtggtggctcacgcctgtaatcccaacactttgggaggctaaggtaggtggatcatttgaggtcaggagttcaagaccagcctggccaacatgatgaaacaccatctctactaaaaatacaaaaattagccaggcatggtggcaggcgcctctaatcccaactactcgggaggctgaggaaggagaatcgcttgaacccaggagatggaggttgcagtgaaccgagatcgcaccattgcactccagcctgggtgacagagcaagactctgtctcaaaaaaaaaaaaaaaaaaaatcaggtgcggtggctcatgcctgtaatcccagcactttgggagtccgagaagggcagatcacgaggttaggagttcgagaccagcctggccaacatggtgaaaccccgtctctactagaaatacaaaaattaacctggtggtctggttgcggtggcccacagcggtaatcccagcagtttgggaggccgaggcgggcagatcatgaggtcaggagtttgagtccagcctgaccaacatggtgaaaccccatctctactaaaaatacaaaaattagccgggcatggttgcacgtgcctgtaatcccagctactcaggaggctgaggcaggagaatcacttgaagccaggaggcggaggttgcagtgagccgagatcgtaccactgcactccatcctgggcaacagagcaaaactcggtctcaaaaaaaaaaattagccaggcttggtggtgcaagcctgtagttccagctacttgggaggctgaggcaggagaattgcttgaacccgggaggtggaggttgcagtgagccaagatcgtgccactgtactccagcctgggagacagagcaagactccgtctcaaacaaacaaacaaacaaaaatacaaaaagtagccaggtgtggtggcaggtgcctgtagtcccagctacttgggaggctgaggcaggagaatcgcttgaacctgggaggcggaggttgcaataagcagagatcacaccactgcactctagcctgggcaacagagactctgtcccgccccgcgccccccccaccaccctgcgccaaaaaaaaaaaagtaaggtgagatcacagaggactgtggggtcgggtatcagaacactcagggctgggccctgcctctgacctcaccaatgatgaccttgggcacatccctggactttagtcacttctgtgattagggctttcagtgaacatgctgccgacagggtaggttttctatgaatgctttcttcctctgccagttctgatgttctttgagtctatccttggaggtaggatgaaatgggctaggtttgacctaatgttttctcatcctttagccacctcctcctagaggcccctttttccttagcatagttctgtatgccacaaaagatgcagaaaaaaattagacaccatcaatttccaaagagctatagtcttctgggaaaatgacaagcgatagggagaatgtgaaaatgtcagtggatgccaataatccctgtgtgacatttggccttatctaaaatatgctaagataaagagggatggaagagggtggtattttctgacttctgaggtcctttacaacactatcattctaagattctcctgtgagtatatatgtgtcgggggagtgggtctctgcatgtccagatgtacatgtatgttaacaaaaataaggaatgtgtccgatatatgcagacttgggacaattctttcccattctttttacttttaaatagatatataatagttttattgagatatgattcatgtaccatacaattcacccattgaaagtgtacagttagggccggatgtggtggctcatgcctgtaatcccagcactttgggaggccaaggcaggcagattgcttgagcgcaggtgttcgagaccagcctggacaaaatggcaagactctgtctctactaaaaatacaaaaaaaaaaaaaaaaaaaagccaggcgtggtggtgcacacctgtggtcccagctacttgggaggctaaggtgggaggattgcttatccctgggaggcagggcttgcagtaaacattctcctgcctcagcctcctgagtagctgggattacaggtgctcgccatcacgctcacctaattcccgccccccagcccaaggagtcttgctctgtcacccagactggagggcagtgatgcgatctcagctcactgaacctctgcctcccagtttcaggagattctcctgcctcagtctcccaagtagctgggattacaggcatgtggcaccatgcccagctaatttttgtatttttagtagagatggggtttcaccatgttggccaggctggtcttgaactcctgacctcatgatccgcccgccttggcctcccaaagtgctgggattacaggtgtgagccactgcgcctggccaatttttgtattttttatagagatgtggtctcactatgttgcccaggctagtttcaaactactgggctcaagtgatcctcctgcctcacctcccaaagtgctgggattacaggcatgagctaccgggtctggcgtattacccaattgttttatttactttctcttgattgctagtaaggttgagcctcttatggtttattgtctgtattcatgttgcctgtgaattacctgtttgtttcctttgttcctttttcttttaagttatttgtctttttcttcttgatttgtaggtctttattctagatagtaaaccttttgtcatttaaatatattataggtattttcaatatgttacttgtttttttaacttatctttcattgcatagaagtctttaatttttatgaggttaggtttatcactcttgtcctttattaaaacttttaggttttgtgtctttcataggaagcccttcctcattttaaaattagaaaatattctggccaggcgtggtggctcattcctataatcccagcctttggaaggctgaggcaggtggatcacctgaggtcaggagttcaagactggcctggccaacatgatgaaaccccgtctctactaaaaatacaaaaaattagccaggcatggtcgtgggcacctgtaatcccagctactcacaaggctgaggcaggagaattgcttaaacctaggaggtggaggttgcagtgagctgagattgcaccactgcactccagcctgggcaacaagagtgaaactctgtctcaaaaataataaaataaaataaaataaaataaaatattctgtattttctttaaatacttaagtttttttttagtttgtatagttctttaatacatctgaactttattttataagataacagtttgacgctatgtttttttctacatggaaattttcccaaggccatttactgaggccatcctttccccactaatttaaaatagggtgagaaccttttaatggattttggtaccaagtgagaaactgctttcttaaaaagaatgaactagtttatgcaaactgacatgggcaatgtgtatctgcccatttcactgcagccttgcgagtattagtatggttgttgtattgattgtaatttaagttaatttaaattacaacttaatttgtgtttatattgatacaaagttattttcatttctcagtgatataaataatggtatatggaatactttattgaatagaatcaatgccaaaacacctggtattatagaaagccttaaaaaatgactaggggcaggcgtggtggttcatgcctggaatcccaacattttgggaggtcagggtagcaggatggcttgagcccaggagtttgagtccagcccgggcaatacagtgataccctgtctctacaaaaaaatttttttaaattagccaggtaggtggcacacacttgtagccctgcctactcaggagactgaggtgggaggatcacttgagcctaggaggttgaggctcccgtgagctgggatcgtgccactgcactccaacctgcacgacaaagtgagaccccatctcaaaaaaataaagaaagaaagaaaatacaagaaaagggccgggcacggtggctcacgcctgtaatcccagcactttgggaggccaaggcgggcggatcacgaggtcaggagatcaagaccatcctggctaccacagtgaaaccccgtctctactaaaaatacaaaaaattagctgggcctggtggtgggcacctgtagtcccagctactcgggagactgaggcaggagaatggtgtgaacccgggaggcggagcttgcagtgagccgagattgcgccactgcactccagcctgggtgatagagcgagactccgcctcaaaaaaaaaaaaagaaaatacaagaaaagaagcgtgaagacagaggctcccgcgtcacctctcattttcttccattttctcttctgtgcctttcacaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggtaagagcctcagatgggtcgccagggttttgtagactgcctgctgactactgtatcttgaaggtccctggaaacaattctaccttgtagaaaaagcacaggttttataaccctgccttgggggctgtgtgacgtagaacaagtgtctaaacatctctgagtgtcagcatcctcatctgtaaaacagaaaacatgaccctatctcttaattccatcaaataaggattaaatgagaatgaccgtgaagtgcccagcacattgcctgggacatagagatttgataagtgacagctattgttgtttactattgtctttaaaacattctctctacttcaaaggagttcagaagctataataagaggcaaatgggctaattgctattagagagatgtgagcaaagtgttatgcaaacacagagaaaggagccattaaccctaacttgaacatttatggagagtgcatcacagagaaggtggcatttaccagagagcattgtgcacagtggtttataatgcacaaagtgctctcagggttcattaattcatttgatcttaaaatagccttttgaggtaggtgttattatcccattttacagatgaggaaacaggtttagagaaagggagtgaattgctgcaggccacacaactggttaagtggcagagccagggttgcaacccacaccttctgtcaagtcagaatgatccttgaagaatgaggaagatttggacagggactgcagtagaggaggttcaggagagggggaggtacactccaggcaaaggcaccagcatgcgcacaggcctagagattgaaaagtgttcagccaggtgtcacatctgtaatcccagcactttggaaggccgaagcaaggagaatgcctgaggccaggagttccagaccagcctggagaacatagcaagacctcgtttctttttcgcttttttttttttttttttttttgagacggagtctcactctgttacccaggctggggtgcagtggcacaatctcggctcactgcaagctccacctcacaggttcatgccattctcctgcctcaggctcccgagtagctgggactacaggcgcctgccaccatgcccggctaatttttgtatttttagtagagacagggtttcaccttgttagccaggatgatctcaatctcctgacctcgtgatccacccacctcagcctcccaaagtgctgggattacaggtgtgagccactgcgcctggcgaccccatttcttaaaaaaaacatttttttttttaattagcagggtgtggtggtacacacctatagtcccagctactcaggaggctgaggtgggaggatcctttgatcccaggagtttgaggctgcagtgagccatgattgtgccactgcactccagcctggttgccagagtgagaccctgtctcaagaaggaaaaaaaaagaaagtgttcagcctttgggagcactccatgttgagaggcttaggaaggagaaaaggcaagagagaccacagggatttgatggagaggctctgtgaatgcaggatagagggctatgacctgatgctgaaggccgtgggggccactgaggagttttaaggaggagagagatgtgcttccctggtgctgggtggagaatggctgagtggaggagggccatcagtcaggaggctgctgcacactccactctcacatttgaaaataccccatgaggcacggtggctcacgcctgtaatcccagcactttgggaggccaaggccggtggatcacttgaggtcaggaccagcctggccaacatggtgaaaccccatctctactaaaaatttaaaaattagctggatgttgtggcgggcgtctgtgatcccagctactcaggaggctgaggcaggagaatctctggaacctgggaggcagaggttgtagtgagctgagatcatgccactgcactccagcctgggcaacagagtgagactccgtctcaaataaagaaaaaaagaaaagaccccatgaggagcacaacctgggacttggaatcagagatctggtttccagatctagcactgcttgcactttttttttttttttttttgagatggagtcttgctctatcgcccaggcgggagtgcagtggcgcaatctcagcttactgcaagctccgcctcccaggttcacgccattctcctgcctcagcctcccaagtagctgggactacaggcgcccgccaccatgcccggctaagtttttgtatttttagtagagatggggtttcactgtgttagccaggatggtctcaatctcctgacctcgtgatccacccacctcggcctctcaaagtgctgggattacaggtgtgagccaccgcacccagccacttatacatctttaaactgtggatcataatgaagtttcctatctcatggagttatgatggggtttcaggttgataattgggcaagaaagtagtttttaaaccatcaagacaaatgttcgagcctgggcaacatggtgaaaccccatctctacaaaaaaacacacaaaaaattagctgggcgtggtggcacacacctgtggtcccagctactcaggaggctgaggtgggaagatcgctggagcccaggaggcggaggttgcagtgagccgagattgcactactgcactccagcctgagttacagagtgagaccctgcctcaaaaagaaaaaaaaaaaaaagggccaggcgcggtgtttcacgcctgtaatcccagcactttgggaggccgaggtgggcggatcatgaggtcaggagatcaagaccatcctggctaacacggtgaaaccccgtctctactaaaaatacaaaaaatgagccaggcgtggtggcgggcacctgtagtcccagctacttgggaggctgaggcaggagaatggcgtgaacccaggaggcggagcttgcagtgagctgagatcgcgccactgcactctagcctgggcgacagagcaagactccatctcaaaaaaaaaaaaaaaagacaaatgtcagcttatatgaaaataacattttcccttcagttgctccctagatgtggagagccctctccctcatggaggctccttctatagcccttggactggattaacatgtcctcctcctcctctccctgtacccctccctaggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgaggttctttgctccagtcctgcgggagcagggaatggggtgggggtgggggttgtaaccggggtagagcagatccttggacttttcctcaaagactgctgcttctgagtccccgagaacctcttcaaccacagctctcccttagggactgggaacaatttgacaccgtcagcattcaatatttttctaattactttaacttttttattataaaatagttaacacttatgtagaaaagtccaatagtataaaaggacagcttggcaaattattataaagtggatacttataaataccactgagtagaatattaccagctgtccagaaaccccccatggtcccttccttcctgacaatgccctctctctccctagaaattactgtcctgctttataatgtattgccatgtatgtattcctaaataatatagtttggttttacttatttttgaaactatgtagacagaatcatacacattcttttgtggctgacttctttcaagcaacattgtgattttaagactcataactagttcacatccaagcatttgggtaacaatggtgagttaagagggttcacatttgatgatttgtcctgaatatgaaccatgtttgtcttgcttttgtcctgaaattccaatacccagttttatgatggaaattttgtaaaattcaacttgaaccgctcagaagagtctaactgatgatactcatttactggggacatagtatgtgcccaagaacttgacatgcaccttctgtcttccatttagtcatcgttacctttagaaaaagctgattccgttaacaagatctttggagggaatcagcttcacaaacgtagcagtgggtgggggtcatgttggttaaccagttcacacatcagctcactaaaggaaaaaatatttctgcaaaaaatcttcacttgtcagaggggggtgcatgaaatttgagagccatgtgttatgcatccagctcttgaactggtctcagcttcagctggctgcagtgccctaggaagttactatgggaaaagtggaaatagttgaggcccagggaactgatcaggccagaggaagtggaagctcaagatcaactgtgcttattttgctgatggctgggcctaaatgccccaaccacctacttgggacaggaaatgacaggaccctctcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagcttttttgcccagtggcgtgtatggtgtttattgggggttggattgaggtggggattttagggtaggcaggcttagaagttttgggggactctttcctgttgactctctagtttggacacaggttggcatagggcataggttacttgagctctccccatggttgacttggctttggtaaacacctgtcttgttttcttctacgaaataaaatggataattacagttagttgggcgggtggggtgtcaggtcatggaaatgctgtgacataaatgcactgtgaccttggcaagtcttgcaacctgcagcgcctcaatttccgtaagagatttgaccgattgagttttcccagcgtcgacgcgcaaagattcctcgcacttggaggcccttttccaggttagatggttgctaacctcggagcagtctattttcccgccttttccgcgcccagcagcagcttcctttgcccctcccaacttccaccctgcgcgcagtcgcagatcgccgctgctgtccgtccacccgcgccccctcaaagcttcccctagcaacaagctcgggctcagagcgaaggcggggcgagcgcatgcgctgcagctctgtccaccgccagtcgtgggacagagtgccgggctcctccccttgcaagtctagctcttctccccgcctcctccggcctggggtccgcgtggcggggcgggcgcgcactcgggcttggcggctgccggtctcccaggccgcggcagtgaggagagagggcggggctgagtcctctgcgcccccgccccctttagcccggcgtccctaccgcgcctgcgcgctcccgcccggtctccatcttggaattgggaggaagagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggtgagacacggggtgcaggggcgcgggtccctgtgtctagttctgagaagaaagggtgcgcctttctgagaagctggacttgggtaggccctctcaggatggggaagcccagctgagcgagtggtcagcctctggctagccttgccttctgttgccacccccttccccttcctcttcccttcattgtgtctggttggtgggggacctcaggtgacagggtctctgatgtcaccggcgttcacaccctagggtgcttcagctaatcagatggatttgcacttcagtcttctctccttcactttgcccctcacagccacctctcctccctgatatgtcccgttctcctggctattctgtggttttgattcccatgcctctgattcccatggtgggtctgcttatctgcttttcaggcctggtctggttggatttcttgtccttgcaaggaagtgtgtgtatatgtgtttgtgtgtatgcgtgtgtgtgtgtgcttggaggtgcctggcaatgttttcccccagctgcagttaccttccaacctcttgctgtgatggtgtcaataatctcatccatttgtcaaacgatctgtcttttacaaagtgctttgacagccattctctcatgtgacatccccgcattcaccctgtgggggcctcttttattggcatcttcccattttacagttgagaacgttgaggccgagagaggttgcccaaggtcacacagtggcagaaccagaatttgaactcaagtcctcaatcacatctttccctgatgcatgcctggttcttgccatctcttttcctctgagtttgggctcggccaggggtccctaggagtccaggctggggtgaggtttaagaatggggatgagatgagcttcctttccaggagggctctactcagaagcttttcctgatgggagcctctggcttttgcctctgcctcatggagttttctatccactgtgaccttcatctttaccccaatcccagggtttggcctggattcctgagagggctctctcctgacaaatggtagcactagtggcatcttttaactgttcaagccaagctgttggggtagaatgatcccccaaaggattaaagctttgtggggaccttggaggcagggaaggaaaaatccatatgctgagtgtctgcatggtgttcctaagtatgagatctcattaaaatcttaacaacagctccatgctgtaatccatttcactgaagagaagaccaagaactggaaggaacttatttaaagccctgttgctgtacattgcagacgggatgtactggtagcatagcttaggaacagatagatacgggtttcctcatctgtagaatggagataacattgttcgttttggaaggtggttatgatttagcacagaccttggttattgttcaagtgtttgttgttattatggggaaggggacctgcatgatgttttgccagtgggtggcacccctccgtgtggcctaggttagcattctggggccttgtgttggtaaagaggtcaggaagattcctttggcaagttgagagcacctgcctttgtgtgtgggtgtgtggtgctggtgaggggtgcttggcactgttgctggcagaagggagaaaagggccggctttgagcaacctgcgagctgctgagggctgagcagagagcaatcactcagtctcccaggctattctgagccctctgcaccctgggggcccactggagagtcaggctccctccttgccctccagcttccagttgggctgagacaaaattaacaacacaacaggaaacaatgcatgacagaataaattacatgctaaaattgttaggtgcttttgagtagctagaactctgccccaggagtccagctctgctgaaggctcctttgtgcctaaattctgacaagtgcttaggctggagcctgtcttggaatctccttgagggttttggttctggtatcctgcaggaactttctccgggtgtttggttgggtgccctaggtgctcttcccaatggctggagtggtcaggacaggcttcctgcaagaggggagctgagcttggggtgacagctgagagagtaatggatacaggcctaaccggggagccgaaggtcctgttctctgaccttggagaagtcctttttcttctctgtgcctcagtgacctcacctaggaaatggtgatcatgattctgccctgcctgtttcgaagggctgctctgaaatcatagtgatggaggaccagctttggacaaggcacttaaccttgctgagcctgtttctttatctgtaagataggggaaatcatagtacttgcttcataaggttgtagtgaggactgaatagagataatgcacgtaaggtactcagtaaatgttatttgtaccctgcaaatgtcctgtacctgtgtgtgatgcttatgcagttggacaggacaagtaaggtggcccagagcacagagaggccctcatagccagatgccatttatatccctattcttcccattctagatctccccctgacttttttgagagtgactttgcgggctcctctgggccagtacccacttctaacaatggacggatttccaccgcctccggcctggccatttcctgttctcttccagggtgtgagaggttgagggaggagggggcctcagcgccaaggggaacagaaaggtgcctggaaacagttggggtataggacttatgggacaggacacttggggctctggagtgctggctgggaagcagaatgttttatccttgaggggagatacaggggctatagggaaatgagaacttgttgagcactgaagggggtggtgaggatacttagcttcccagaatcttcctagcagttttagggactccagggacccagcccgcgtgatctggttgccagggcaacttcattttttggagctttgatgttgttcctaatctccccctccccttcctcagcagtgcctcctcctcatcagggaatgaggggaggagatggcagaaacttgatgggtcccttcctctccctgaaggctcaatccttgatctctaagggtcccatttccattcctcaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgtgagttgggtcttgggagggtgtaatagggatggggactcttcctatccctgtggacttcccaacagcccttgcacactactccatcacactggtctttcctgccttctcttgctgggccagcaagtcttcccatgcccggctctcaatggggccttcaacaccttctggtctggtcctctaggcccgggatgtccggaatagtgaggtggtggccatcaagaagatgtcctacagtgggaagcagtccaatgaggtgggccaggtgcaatacagccaggttggggacaggggactcctgtctcaagatgcaagctgggtaacctctgcctaccctgaccccctagaaatggcaagacatcatcaaggaggtgcggttcttacagaagctccggcatcccaacaccattcagtaccggggctgttacctgagggagcacacggcttgggtgagctggtgccagattctggcctgatctttactcctattcatgcccgtccttatcgtagtccagtctcttaggtggtccctgttcgtggtgctgttgtgggatcttgggaaggaggaagtctcttttgaccgctttagtcctcagacatacccactgagcaaaagcctggctcagtgacacaggctgttagcaggtgggacaggtcactgtgggctggagaaggtggagattgaatgggagtttgaagggattcagatgggcagtggtgaatgtcttgggcccagactctagaaactctcccaccaccccctcattgtctccagttgcgcttcctccctgtcatcaccccggggacatagcttgagtacaggacagtcaaggaagctctgttttgagtccctgcccaggagactctgatctctgacccttgtctcttccttagctggtaatggagtattgcctgggctcagcttctgaccttctagaaggtaagtgactgataggccaataagtggagaagggagaagagcaggggagccatagggaagggttaaggggagtttattccagtcccacccttgcgctccctcgggttgatgttcttcctcactctccagtgcacaagaaaccccttcaggaggtagagatcgcagctgtgacccacggggcgcttcagggcctggcatatctgcactcccacaacatgatccataggtacaagcagcaccggcagtgcctgggaggggagtgctatctgcaccacctgtcacttagctgggctgcccctgcctagctttcttgagacacatgtctcatccctgtactttgcctctggcagggatgtgaaggctggaaacatcctgctgtcagagccagggttagtgaagctaggggactttggttctgcgtccatcatggcacctgccaactccttcgtgggcaccccatactggtgagtgagtgagtggtggtgagtggagagacctcccagggatgttgggagtaggagtgacagggtctcggcgggtgatttgcctctctctcctgaccattctcctaggatggcacccgaggtgatcctggccatggatgaggggcagtacgatggcaaagtggacgtctggtccttggggataacctgcatcgagctgggtaagaacatcctccctgttccctcatcatcttttccattctttcctgttagttcccagactccggactacccccttctcctagggatgggatcccaggcctccaagttcctgtccgttgtgactctaccctggagcccaatacaggcagctggcaaattctgccagctcttaggcctagagattttgtagcattcatctcttcctgtccactaccctggttctgaatcttttcttagtgcccaccatgtgctgtgccatggactgtgattctggagggatagcagtgaatgaaaatcctgccctcatggaacttacatttgatttagggaaaccaggcaggcatgttttctttcaatgtgatgaacgctgtgtggagaagttacaggagcggttcaaatgtaaaacaggggacttgacctagtttaggggctgaagaaggcctccttgtaggagaatattgaagccaacctgcaagataaataatagctgtttgcagaatgtagggaagagctttccaggcagagagaacagcatgtgagaggcctagaggtaagtgcaggcctggggaactgggactagcttcagttatttggaacctagcatgtaatgcagagaatattgaaggataaggccagagagttaggtccaagtgagttcctaaggccttgaagccatgccaaggttctcatctctgtcagccagcactattgaaacaattctttaatgaggtaggtaacctttataaggcttccaacacaatgccaggcacaaaacagttgcctaagagttgctgttagtttctcttatcaacagcctcctgcagtgatctctccagtctcttctcccttccagtctgtcttaagtactgatgccagagaggtctgcctaagctcagtgctgtcatttcactccctgtttggagccatgagtggccccctgttgccttcaagactgaagccatccccatccttcctcccaccaacctagaggctttgcttcgtaaatgctggccctttccttcatgggctccaccctctgagtgtgtcatgaactcttccacttccttgccttggttcgtattgggtcctctgcccgaggtcagagatttggacgagcccttctcctccatcttcacagtctccatttaccattagatgccaggcccagacagttgatgaaaaatgtaagaaacggacccaagtataagaaaaagctagatctgtccattttatttctagtttttggaagagatgtggatacagagaaatattactctactattgaaaaaaatatatatcagtctgattataaatgtcaactcatactaagtcaatatcagggaagcagtgtggagaaggatgtggcaaactggagattgctgtttccatagaaagagggcagctaatgcttatctccagaccattgttatgcagtaatgtagactccatttcaccagatttaattcttaaggagaaactggaaacttgtattattatttgattattacttttggcagttaattttaaaaatcaccgtttaggccaaaacaacatgacatttgtctgggctacaagggactcttagcgactcttagcttgcacttacctttctaatctcagggctttttacaaagcccttctctgaattccctgaagatatgctagcttgaaggctcactgcatactctcaacttcccagccacttccctgtttccctcttataccagttaatactttgatgttattttttcagtcctatttaatcttttagactggaggttccttgagggtggggcctaattcttgtttttatcttccccatagcaattatcaagttatctgctccctttggcacctaagaaatattagttggggtgataactgaatggctgtccttctgccttcgttactgcttttgtggatgttattttctttgacccctattccacccgtgtgcagtggagaggatgggtgttgtattttacagaggaaggaattaactgagacgcaacaggatgatgggaacttctcaaggtcatgtggcaaggaagtcaaggaattggggtttgaacccaagtcgtctcagttccattccattgtcctctaccccctgccacctctcaccttcttccctttcacctttttctgtagctgaacggaaaccaccgctctttaacatgaatgcgatgagtgccttataccacattgcacagaacgaatcccccgtgctccagtcaggacactggtgaggactgagattccgaatctgggcccaggcgttaggccatggggtatggatgcctgactcatgccttccccacccctctcccaccctcctgtgactttcaggtctgagtacttccggaattttgtcgactcctgtcttcagaaaatccctcaagacagaccaacctcagaggttctcctgaaggtgagggcctgctggcctagcattctcctggaactgtagcttgttacagccacaagaacccccagggaaattagtggttcccagttcctcctccaccaagagcttcgttgatgaattcccaccccatccccaatgcctagtggactctgtgttttacaagattttgtctaccagactgccttaatttattaagtaataaactgttttcccttcttttattaatcaaagatttatataattgccagccagagcttctggtcagcatgtgataaccagggttgccccactgatctgatgtaatgcaagccaaaagcctgtgtagccttatcatgggtaaatgtatgatttcccttaggtgttttttgaattatcaaaaatggaggggccccattcccttcacagacccatgggggcctgaggagccgtagttggaaacttcagattatgtagttggacccacttgttttataattgtaggatactgtatgaagcccagaggggcctcatgacatgtccaaggtcacatagccctttagtagaggagctggacgagaatccagttctcctgactgtccctgcctgtcagccatgcttagaggaagaagagtctgtctggggagtaggtactgggtggtacagaaaattgtgagagaagggcttgggataaggccagcatcaacccgtggtgggcgtgggccccagaagagtgcctcaggcctgagggaatgccaagggctgtgggttgtggggggaaggggagttggcagcagacctcagtgccctcttcccccagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggtgacccagcttgccctaacacccctctttataccccatgtgtgcctgccccctgcagttgcttggccccttccccagccctactcacaccaccatcttcccatgctacctccatgcatatgccccagggcttccccttccctgtccagcagcctacgccctgttcgcaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccggtacacagctcacccttgggggacccgagccacctgctctagaactgcctgggtcttcgccctccttccctaagtgcagcactcctctgagtctgattggctgtcctcaggtagctctctttggacccagtggcctctgagccttgggtgttccttctatctccctctagggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtgagtgtagccatcctcactcagcctgctcgctgtctgttttttaagtctttttaagtctagaaatgatttcctccctgtggcatgggattgagtctggattctaccctcattttctgttgctggctcctgcctgctccccttaaccctcctgcttccctcctcttcccagtggactgttttggtcatatggcccaatctgggtgtttctagcttggcaaactcttactccgtttttgtggcctgacttaactgacatctcctgggttgccttcccaggctcctctggtgagtcagatgcttcacagttgtgtgctggggaagcccagtgctgggggagccctgtgcctgtggagccctgtgctgggggtgtccagtgctggggagccctgtgccgggggtgccctgtgcttgggtggtcctgaacagcatcatgataggtttgccagattctgtgccccagagggcagggatggtgttcagatatctgtctcatgccagcagttagctctcaggcttacacacaggcctgtgttaaccctcccagcccccctgggaggggaagggtaagatcccattggagaaatgaggcacctgtggctcagaggggccacttgccccagtgcctttggtggctctctgctcctgtaagcaggcccttagtcctctcctaaaatcaactcatggcagtctttctcagttcacaggaaaaagtgtttaggcttttcataaaacatagtttttcatctatgtttttagatcacgttcctgctgagctgcatttgagcgtcaacaatccccttagaggccactgattaagtctagtatgttcttatggcctctgcttggtgctggttgtgttccaacaattcttcagatcccatggtgttgtgcggtactgtgctgagaggtcttgactgccaggggcttggctgccgggactagtttgagagccactcatagagtcaattgagaatgagacctgagatcagactttggatgaaggtgtccaagcccagtgttcttgttattccagcatcttgtggccccgatcccacctcaatacctggggagtgataggccgaccatgtttgctgaaggggaaggaagccaacacttattagatagagtccgaacttaccccacagcccctatgaggaggtattatttccccatttaacagatgagggaactggtgctttgagaagttaacttacttgagatcacatgcttggtaagtggcaaagctgggatttgatcccaggtatgtctgactcactgtttcaaattagtatggattgttcctacttttgtgccaggccctgtgctcgccaccttttatcattcggccacaccaacttgtgatgtagataatatcaccattatccagttgaggaaacaggctagagtggccgtgtgtgaggaaggtgttaaatgagaatgaaacccatgagttgaaaacccatgctcttccccacggaagaccccttgtgttaattaactaggggccaggctgagccccagctctcaccctctctccttccccaggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggtgagctagggctgcttgggggcggagccgatggcgagccaggtgggtcctgaccctgcttccctctgcactcgcccaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggtaggcatcccaatctctgttcccctcccgctcactcgtggatcccagggacccacccttttccattttcctcattcttgtcttctttctccttggccctcgagtgttacagttcagctttgcttcagtgccccttttacttctcatccccaacagaccctgccagaatttccttaggcctcttttcccaggccagggaggagcttgcctcccctacaccctcatctcctgccatccccagctccctctgccaaggagccctggcccctcacttccttgatactgaccaggccctgggccctgtgtttcttccgccatccccagctccctctgccaaggagccctggcctctcacttccttgatactgaccaggccccgggccctgcatttcttctgcctcaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtgcctttggcccaggctgcctctgtctgctttgtcctgccgcctagcctccccggtatgcccccaggctgaccctcggcccggctccatgacctcttcaccccatctccgttatctcagccccctcactcctccagcctcatgctctctgccttcatagcttcattgcaccatgaccaccaccggctctggggtctgggcccctgtagaacttcaccgaacttcttggtcccacagagcgcctgtttgcgggttccttccagaggtcttagtttccaggcccttggtctcctcatcccttgccttttctcccaaccatggctgcaggggaccaaattgctctcctgcatcaggcattaccctagtgggttgggggacggggctgcagaccctccacagtagggggtgctgagctgggggcaaccaggcggagtatgaaggctgtggcagcaggattgagtgtgggcctggagtgggagctgagtgtgtgaggggccgggctggaatgcggatctggtcagggtggtagctgctggccggttgaacttgtcaggccctttctggccacctcctttgcccctttctcctctgcggcccaaaatggggcagccccttcttacccatttctcagctcggtgcttctcctccttccctgccttcctccctgagctgctggacctgggacttcctgtgtctgtccttagtcgtgttgctttcttcatgggtgttttgtgtgactggttcttctcgcttgttctcgtgcacgttctcatatttgctcacgtgcttctgtctctaggtcacagtctctccctctttgcctggtcagagcttccaagatcctcagttccctgtccagtaactccgatgttctttctcgtgggtatcgcacccaactccgtgcacgtgctcttggaacctcttgtcttctctgcatctcttgcccatcgagaccttcctgatctctctcaacacgatcccacctctccatgtctgtctgtctgtatacagctccccccaccccctctgtctaacatgttttctgtttctctccctctccctgtctctgcttctgtctcctctcctcttctctctcttctccccatttcccctggttgttcctcctcttcctcttcctcctcttcctcctcctcttccccgctgcccccatctccccttgatccgtccactgcatagtctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcggtgaggcctggggtccagggagggagtgcgctagaggccaggctctgtactttgctttagagaaatggacggtgcagggcatgcacagagctggggcttttttacttgggaaactcacatactctccctctgttcgtgttctccacaatgatttatttcatattctcctcagtggttttattctttctcttagtattttcttaaggtcttgacaaagccatgtgcctattcccaagaaccaccaaggaaaagagtggctattatttttttcctgggcctgagttagtttaatgggtaaacagggtgcagattaaagtgagtgtggccctcaagcccatttactcagacttctggaggattttgaaagttgctgttctaaaaaaatgatcacacctaacactggaatgggccacttaaaatgtgcggagagggtggagagtggaaacgccccacccaaggctgttctctcacccagtcccacctctcccaggtaacttgttaataattaactgtattttgtgttttttcagtgcacattttgaaaaattatatgaattttaaacacagatggaatcatactttacatttactttctgtaacttcttttttccacttaatatttcttggacatcttcccctgtcagtacacctgtctcattttttttacagcatagaattttccatggtatggctgtaccataatttatttaacccatcccttattggtggacatttaggttgtttccagtattttgctatcacaacgcttccgtgaacacctcgagcacatgtgcaagtatacctgggggatagattctgcagtgtaattgctgtgccacagggtatgaccatcttccattctgatagatgttgagaccgctgcttcttgaaaccttagggcccaggcctacctggggcaggggaggatagtgggggtgggggaggagatccctacaactggttgttcatcttccccagctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtaaggggcccagcctccaggactggggagggagggtgggctcctgcccccgactctaacctctgttccggatgccccaggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgataggtgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacagatctcaggactcacccttctgtctttggtgtgcgtgaaggactgctcagtggccactgaatagtactgcttgtgttttataaagagaatttattgggctgtgtatctaaacatttcagtgattttaatgactttaggtgtgaccagatctcggatctcaaaggtggtcttcaaccccttgacctctaattcgttttctttgctttgacttcaaagattcttaggtttgcctcccacacagaccccaggcagctccatgctcacgaatcttcccgcaagcctcagcagccagagttcagtggagacctcatgtgactgcagaggctgggcctgtagccagaggcctagagggctaggactggcccaggaggtatgggcttttccccacccctttgaggctaacagcccatggacaaagtggctgtttgcataagggagaaggcttaagcactggctgccctcaagtcattctatccctctcccaagtgggcattaggttatcagactaggctaaaagcagaggggccacggggtaggcgggcagcacaggagccacacacccttctccaaaagggtctggtggctgttggatgacagggtctggaggcagggacttcttccaggaacccgggggaaattaaagggaaccaggccaggggaggaggtggaggcagtgactactgctcagtttcctggcccaaaatacaggaggtgagaatgggggaccaaatttgatgaggtgattaaaaacactcctttattgagtcttaaaaaataaacaccttaaagggacagcgtgaagctgagaagtagcatcccaacagcttgtgtccttgggagctgcagtcttctctgaaggaagctgcttctgttccacagacacagggcaaggggtgctatgtatgctttgtacatgtatcaagggtccctcctgggggtggcagagctcagttactctcgccatcactgctgatgatgccacgcatatgtgaccagtctgggggtgcgggacggggccgctcttcatctgagtccagggtccgtcggtacagctcccctgggggtgctgcttctcctaaagggttccaggctgtacgtctgcgtggccggcctaggggaaaggggaaacgagagatcagatgtctgagaaggtccaaccccacctatctgctcctgggcagtgagaggaaaccccttacccgagccactgatgatgttcgcaacatccaaggaggccacctcagctgcctcctccctctgctccttcagggcccgacacttccctagggaaggggtacctggggcagaagaagctggtgattctctcctccccagcaggaaggccctctcctgcagcccccagggcacgccgggcctcacccttcatgcctagcgcttccagttctgcccggaggatactcaggcgctccttgtgtgagcaacaggagcccaacagcttcttgtagtttcgatgggcaccacaggcccgaatgtagcgcttcagcctcatcacagccgggtggtcctctccacggcgacctgagccagcctagcaaggaaagagcagctgaaggccaagcctgctgggcctgaggcagggtctccctcttccctaatagtggcctcccacccctcctcaccctcaccttccctcctttggcctctggacttccatctgaggaggaagaggagcttcgtgtcctgcctttcctggagctcttcttggaagagcggttcttcctctccccctgggggcctccccctgcctcgctgtcacttacctccctctccaagtcactttcctcaccactggtgctgcccagtctggccatctttctagagcctttagctgtgggttcccccttcccactgtcttcctcgtcctcgctgcttccactcaacctcttcccacccttaagctgggtcctgtcctcactcttcctctgcactgggggttctctatctctcccactgtcatccccactgctggctgcctctttctgctcttcctcgctgtctgagtctcccaagagcctctttgcctggcttttctgcttacagctcctctcctccctagctgactttctccggccattgctcctggttctgggtttccaatcccccttttcctcatcctcttctttctcttcctcctccacttcctcctctctctgctctttcttctgggctaggatctcctcttcactctcctgttcactttccttcaggcttttagttcctttatttccctccaccttctttgctgtcctctgaacgggttctgcctcgctctcctcactttcttccctggcctgcttcctactgactgaggccttgcctggtgcctgcttctttaccacaggtttcttcctagtcttccccttgtaccccttttcctcctcctcactgctctcctctcccctctgtgcgggcaggtccctctgccgttcctcatcactgctctcctcaactgcctttgaggctcgccttggattctcctctttggctgggctgacttctgctgccaccccattctttgctgggggtccaaagtagtctgggctggaggcttcagagccggactctggaatatggagaggagagagggttgagacaggctcctcctgtcccttctcccttcacttcggataggttgcctcgagccctgccctgacagttggaggggcagcaggaaacagctatctgtacttgctgttcccggttcctgactcactagccttgctccctcatctaacgcctggggacataagagatgcgcagtgaatgcttcttgagtgaaccaacgatgcagaaggcccccacagcagggaggaagcactaacccgactctgaattgaagcggaacctttttctctccgggtcgctacaaggggtgggaggcctcttgcccttcttggtaaggtccagtttgtcttccctggaagcggcttcatccacctgtgtgtgcgccaagagggcaaactatgcaccaaggctgcgctcaccgcgccccgtcaggcccctcctcctcagcagcaagccccgcctccgcctcccgcggcccaggctccggcccggcacacctgcatcttcagcagctcctcctccaccagccgcttcagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgtgagtgctgccgcgggaaggctgtgggggatgaggcctggcgcggacaagatctcagtttacccaggtgtaaagtgggtggggcgagcggccgctggttccggggcccttcacggaggaccgttggcccagcgcaccccttgcccgtgatacaggagcacgagtgcttccaggaggagctgaggaaagcgcaaaggaaattactgaaggtgtcccgggacaagaggtgaggcacgttgcaggggcggagggcgatgtgcttcctaggaaatctacattcggaccccatccccgagtagggccacaagtgcatgggctctttcaagtatccgatgggccagctgggagggacaggtacccaggaggacattgctgcgctggaaaatcactgtccgtgtctccttccctcccctcagtttcctcctagaccgacttctgcagtacgagaacgtggatgaagactcttcgggtgagcaaggtcttcaaaaattggtggagagcatggttcctggtacttagcaagcttcctgggcccccgccttttaggcagtggtggctgatgcagcccccagtggtccttaagcctagttgcttgccttccacctccaccgttctttcattcaggcacttactgagcacctattgtgtttcaggcactgtgcttggcacaggggatacagcagaggcagagataggcaaagcccttggcctcttgtaatttatattctagttgggaagaataagtaaatgaagacaatagactagaattttaggtcataggaaggacttgaaggtaatgaaaacagttatgcggtaatgattatagtagaacaggggttgatgaattgtttctgcaaagggccagatggtaagtaagctttttgcaacatacaatctttgaagcacctactgaactctgccattgtagtagcagccgtaccccataggcaaatacatgagtatggctatgtttctataaaactttataggcactgaaatttgaatttcatatttttccatatgaaaaatttttctttagttttttttttttccaaccgtttaaaagcttaaaagccattcttggccaggtgcagtggcccacgcctgtaatcccaacactttgggaggccgaggtgggcggatcacaaggtcgggagttcaagaccagcctgaccaacatggtgaaacctcgtctctactaaagatacaaaaattagtcgggtgtggtggcgtgcacctgtaatcccagctactggggaggctgaggcaggagaatcatttgaaccctggaggcagaggttgcagtgagccgagatcgctgccactgcattccagcctgggtgacagggcgagactccgtctcaaaaaaaaaaaaaaacgcccttcttagcttgcagaccacacaagcaggcagcaggcaacctctgaatggagtactcaagaaaggcctttcacagagtgacatttgagttgggaccagagaagaaaccagccttccatcctgggcaacatagtgagaccccatctcaattaaaaaaaaattagccatgtatagtggtgtatacatgtggtcccagctacttgggaggcagaaccaggaggatcccttgcctgaaaggtcaaggctgcagtgagccatgatagcaccgctgtgctccagcctgggtgacagagcaagactgtctcaaaagaaagaaaccccatcctggctaacacagtgaaaccctgtctctactaaaaatacaaaaagttagccggggatgttggtgggcacctgtagtcccagttactcgggaggctgaggcagaagaatggcgtgaacctgggaggtggagcttgcagtgagctgagattgcactactgcagtccagcctgggcaacagagccagactccatctcaaaaaaaaaaaaaaaacaaaaaccaatcttgtgaagaagtgggctagagctgtcccggcagaataatataaatgcagctaccctgaggtaagaacaggtcaggcttggttgaagagcagaggcatgaaagagagagaacactgttttcgtccttttatttgaatattgtctgcagttaactatattttacatcataaccagggccccacatgttaaacaaaacaaagtttaacgaaacatttttaagatcactgtatccaattcatcctgacactttttagactgcttttttccccttcttttaatgctggttgcaaaccaataaattgatttcatgacccactaatggcttgagacccacagtttgaaaaagccctaaggtaggcatttgtgggcctcttcctgggtgaggccctcgtaagccatgtcacgtagaatcacctctctccgtggtgcctttaaacattggtctgggccgggcacggtggctcacgcttgtaatcccagcactttgggaggccgaggcaggcagatcacgaggtcaggagatcgagaccgtcctggctaacatggtgaaaccccgtctctactaaaaatacataaaattagctgggtgtggtggcgggcgcctgtagtcccagctactcaggaggctgaggcagaagaatggtgtgaacccgggaggcggagcttgcagtgagccgagattacgccactgcactccagcctgggcaacagagcaagactccgtctcaaaaaaaaaaaaaagcacattggtctgaggcagggattggcatgtggcagccagccacgttttaggacgtagtgttttgtcagaacgcatgatacccatttgcttgttattataggaggattgtagataaggttggggaaataggcaggggcccactcaggtaggtcatagtaggagatttggcttttattgtagcctctcatcccctgcctcttccttccctaggggcttccagttaacatcctgtttgaggggaattcagggcaggaggtgggagagaacccagcatgttcatggccagagtgggttgcatctgaggaggaagagccagcgatgcgagccccactcccgtcctggaggcccacgccctggccagggagacactcgcaaacgacgcttttcagcacagtgtgagggcagccatgacgagagtagagcgttccaggagagcctgcagttaactgggcttgagggattctggaagacttcacagaggaggtggcatttaatctgcttcttaaagggtctgtctgagcagagacattggtaacggcttctataggtgtagcagtcgtttgttcgatgaaagatggcccttctaggcagaggcactgaactaggaaatacatttcttttttgacgaaataggtcagtgtgctttaaagaatacagttacgttagttgaccagaaaggtacattgaagccagattaagcagcaccatgaattcatgcaggtagtgggtgatgtcatcaggaaggatgtgaccaggtttgttttaggtcactctggggttgggggtggacagtgggtggcacggtgaggtgagactgcttagcaggtgattttgacgtgctggtggcctgacctgtgttagttggtgtggggagcagtggatgaaggggaggacttcaggggtagatgaacaggaccctggttatggggagtggggcagaggcaggagttgaagactgctcagctcagaggcaaggaaccagtggcatcaaacagccaaggagtcacagacctggcttggagtcttagcctcacaccttactttctgagcctcggtgacctcatgtgacaagtggaggtgctgcccttcccatccttccttggatctgatgacaaggagaggtggtgagtgggaaagagcctggcaccctggccatgcgtggcaggtgtgttacggaggaaccagagcgggcggggggctggggaggctggagaggctatgggcctccctgggacagctcgagtgtgtggtgcatgcgtgtgcccaccagctggtgagtcagattcccccggggcccttctgttaggttttggtttgtttcatttttttgaggcagggtcttgctctgtcacccaggctggcgtgcagtgttaaaatcacagctcactgcagtctcaatctccgagtagttctcctgcctcagcctcctgagtagctgggactacaagcacacgccaccatgctcggataattgtttttgtttttaatagagatgaggtcttgctaggttgtccaggctgctcttgaactcctggcctcaagcgatctggccacctcagcctctcacagtgctgggattccaggcgtgagcccccgcacctggtcttccagtgcccttctgtagtgtagaggaggttatacctttctgggatggactgggatccccccatccccactgaccagctgtccccatcacagactcagatgccactgcatcatcagataacagcgagacggaggggacacccaagttgtctgacacaccggcccctaagaggtgagaagaagatgcattcctctcgctggggagggtcaggtggggcgcctgggctcctagccacatctgacctcgccctgtcctttctccaggaagagaagccctccgctggggggcgccccctctccctccagcctctccctgcctccttcaacagggtttccccttcaggcctccggggtcccctccccatacctgagctcggtgagttggggtcagggatgggaagtgcttgggagtaaggtgggcgtcatttgggcagaagggctgggcctcggggcaaggccagcccaactttggggacatctgtctgggtgtggcccaagtgtcccgtggagggtgtgagtcggggctgcccccttctctctggtataggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaaggtaccctgacgtgggggtgctagggaggggcaggacggcaggaggacagtcacctgagggaggctgaaggcgggggcctgtcagagaaccatgaacagttaatttggggacccagtcagcacttagcactgaggggtggatcacagaagtctcggcttacaggcttgtatggagacaaatcagggcagaaccagccttggaggacccggtgtgcagatgccagggatcccgccctttcatggctgcagtgtagcggggccaggctcattttcccaggggggcgtgttgtgtgatgccaggtagccccagaccgggtcaggattatgggatctagagtcaagtcaagactgcctgttagaaaccacgtggccttgagcaggtctctgctaccctctaggcctcctaggcttggcacctatagggcgagtggtcctactcgatgtgaccagcaagcgcccctggagcgcctcctgttacacggcagtgcacaaagcagaccagtgcctgccctcacagagctcacagtctagcaagataggcagaaaacacaccagaaaagtaggtacttgtggagaagaacagagcgaggtccagagcatggggacgccagggggacgaggctgacacttagggcccagcagtctgggatgttcttgatcagagacttacaggaaatggcagcaagctgtgtggctcctgggcagtgtttctgtcgggcagagtctgtgtttgggagaaaagtaagcagggaattgggtcccggagcaggtcagagggggagctcatgaggtgccagtgtgcaggattcgctgtgaatgaagccttggagacagcagttccctggcggggcgcaggttgcaggtgtggagggggagtgatctaattgcatcttaacaaaattgcagacactggtggtcagagaacagactgagcggtggagtgagttgggacgggagtgaggaggccaccacggtaaaccaggccaagggcagagggtccagagggagctgcggacccatttcagagaatgagcatgggagttcctggaggacctggtgtgggctgtgcgggagagaggccaggatgcctccagggctttagtctgagcacgagtggagtctccctccctggagatgggagggctgtgggaccacaggcttggaggaaaactgagtctggccgcggatgtgtcagatgccatctggaaaggcagctagatagcggcccgtgaggggctgcgcatttggaagccgccaggctggcggtagatgcaagccttgggagagatggggatgggctgaggggcagagcggagtggggaccaactgggcggctcccagggttctggagccagaagcagaatgagaggccgcatttgcggtggtctggagtacaggatctggagctctaatcccaactctgccgttttctccgtgtgaccttggccctgtgaggcttcacctcttgagcctgagaagcagaggtgacagtactggccctggttcttagcaggggggtggcgggcagggtagggggtggcgcagcactggggggcactttgaggctttctggctgggtgctgagtcctgaagcagagtcatgtccgggagcaaagttgtagacattctggagagaaggtttgagagggtggcccaggtccatggctgtcgggggaggtggggagaagccaggaaaggcctcagcaaggagaacgtgtaagcccagggtgagtggatttggatattcctggctgaagccatagtgggaagggagacagggccacagggaaagcactgcctgggccagagcaggagtggtaagaaattggcaagaagaaccgggtggggtggggtcatggaaggcctggacagtggcctgaagtgggaatttgtctgttactgtcaggggagcgggagtccctgaagggccaggggagtgaggagatggaaggaagggagtccaagcagaggaaggatagctgtgaagacagaagcaggttggttctgtcaggcctgagttggacttggccagctttgaatcccagctcttccagtgctcaccatgcgacctcagcgttgtcatttcactctttaagccacagctctctttctccattcagtggcggcattgtgcggagaatgtgagtgaagggatgaaaatcgctcggcccgtgcctggcccctagtaagccacagagaaatgtgagccgctgccagtcaggctgagaggacgccactgaggaagtccaggccagggtgggacatgctgcgcacagtggggaaggagaggaggtggccagaggaggggatggtcctttccagtcatacacgcatgtctgcttgtgtgtgtacatgtgggggcctggtgcagggcgtgggggtgctgttcagagttggaccccccatcatccatcctgccagcctcctataccctgaggcctgacccaccctggcccccacaccaccccagcagcggagatgagggtaagtgagggctccttaggaagcagagaggaggccacagggccaaatgtgacactcagaagggccactggagaccacgcatggcgtttcctgccagcccactcagcatctagcccagggccagactggacactgccccgcaggacccagcaggcctaagcctcaggacctccatgtccacaccaggttcagcctcctctgctggcacgtgacttctccccgtttcccgccccccagtgtcctgaggctgggagggcattaacagaaaccacctgacacacagcaggtgcccagtttgtgcccacagacaaagcacggggactgcagaggagacccacagagctctctagggagggtttgtgaggacctggcagcgggggggagctgaagggttgagcagggcagaggccacttcccaccctcagaggacaaagcaggacttctgacaaatagagcaggatgcccagggggaggggctgcctgtcgtcccgcaggcggcactcccgccccgaggccccgagtggcacggtgacgcgctcaggtctgtgttttagagcgcgcgctctggctgccgtgcggaggagctggatctgggagaggctgcgggcagggagtccagttaggaggctgggaccgcagcccaggtgagctaagaggagggctgggcctaggccacagctgccgggaccccgaggaggggcccatccaagacataatacaagcttcttgggggcagataagccgctggggctcctggctcaggcagcctgcaataccctccaccgaaccagtgagtgccgcagaagagggagaggaggagtagggagaggaagctggtggcaggtggcacctccggggccggcaggcaggcaagcactccaggccgactccgcctctggcttaacccctgtctcagggcagcccaggcgcctccctggagagggcaggtgcccgggcctttccctcccggtttcctgtgagacacccccatcccctcatctcacctctatcaccacccccaggcacttgctggtttgaggctctcgaggggctgaggggggcaggccctgagtgcagcatgggttggcccagctgtgcccagggcctcttccccctccccagagctgccctggggggcaaagcctagtctcctgaggccccagtgcctccctgactagtccccctgtgtttcttccccctgctgcagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgggtttgttttttgtcctttttttttgagacattctcctcctctgaacctcccctaatccgacctcctccctgttgggggagagggacggggcagcgtggagaggcaggagtgaggagcgcgggggcctggggccgggctctgagcactgcccgggtgtgcagatgatggggggtttgcatatttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagcaggtgggcagggtcagggccacctccctgccacttgcccgccctcaacacccgcagccagctcctccctcaccaatgaagtcattggatttgccaatgtcatagtcccagacggtgacttccagggtcttggtggccagagtggagagctctatctcgtagaaaaactcctagggacaaggccggccacccgttcgtgagccagctccccagcccctccctggcctccctccatgtcccgtcccctcctgggtacctcgttaaattctgggttgagagtcttcttcttcacacacgtcttatgcttggatttcttgtccacatcgggcctcaggtacctgggggtggggtggagggagacgaactgaggggtgagggacaggccaggcccaactcaggccagggcaggctccctggggaggagagggtcagagcaagggctcacgtcttgacgtaggggtccgagtaaccgttgacgtccatggcagccagatgggcgcagcgcaagatgcctaccagcagtccccggcgccgcgagctgtagctgagactcagcaggatgcggccacgctcctccagcagcccctgcccctgctccgcctgctccaactgcggggcacagactcagggtcagcctgggcccctgcagcctcccacccacatgcatccccatccccatgaggtgcctcacctccttcagataacaggagatgcccctcagcgccgctgacatggaagagggggacgccagctgagggggcaaagagaaggttctggaagcctggcctccccagggccccctcccctggcgcccctgcagcccccacacagaccgggacctggcgctcgaggcagatgttaaaatgcttcttctgcgaaggcttgaggcggcggaggggcacgcggatctccccaataaactcattgtgactcagcttgtcctcatcacagacggcgatcctggtcgggaactgcagtgtcagggcccctggggtacctgagccccgttccggggtgtaggaagggccttggaccagcccagctctgccctaaacactacgtctcatctggaagacaggctggcacttgagaaggacaagcagatttgcccattcctctgtccctccctctgcagccacccggctgtccctggtccatcaggacatgctcagccattgtgggaagccctcagaaatcttggagcacgctgctcactgcctccattcagggcctgggggcaggagccgaacaccacggtggatgtggccatagacacaggccgtgagagctagaagggccttggagccttgggcagccagaccagtaccccacgcctcctcgggaacccccgtccttttcctgcatgcagcagagagccagccccgcagggactcactaagaaatgattgctttccagccacctgtcctcctgcagtccctgccctgcctccgcagtgacccactaccaggctgggcatctgtggcatggaggatgggcagatcccagccctgccacttctgagccacctgtgtgaccttgggcaagtcacttgatcaccctatgcctcaattcccatctgtaaatggagatagtcaagggaaagaaagaaatgtgaaaatgctaagcctgggctgggccctggtgagcgctcattttttggtctcattctggttttggcctctggcctcccctccattccacccgaatagctgaaaccaaggtggcctctctgctgcacagccctgaccatcagggaaggtcccagctgcaaatccaagcacaaaggcagaggtctctccagagcctgggtttcgctgcccgccacctgacttgagggagtactctccctacatctccatctcctaggatgacggagcaagttccctgtccctgaagacttcactccttaagagattttaggggaactcaaggcacggaaggggcagaccaaagctgcagaggtctggcttaagccaagggctctgagaaggggtctcggcaacccaggaacgtttttgggagggggcagagcttggactgaacctcagatgagcggaatttaggctggcaggaaggagctttccagatagaaaacaacaggaaaagttcaggagttgtggaactggccagttggaagaagggagtcctctgtttgaggggcagaagatacttttgttttgtttttgagatggagtctccatcacccaggctggagtgcagtggtgcgatctcggctcactgcaacctctgcctcccgggttcaagtgatcctcctgcctcagcctctcgagtagctgggatttacaggtacatgccaccacgcccggctaatttttgtatttttagtagagacgggggtttcaccaagttggccaggctggtcttgaactcctgacctcaagtgatccgcccacctcggcctcccaaagtgctgggattacaggtgtgagccaccacacctggcaggcaggagatattgaggggcaggaatggcagggaagaattttggcctgctgccaaaggggctagggagccgctgatggttcttgagcatcagagaggtacgggcttaatgggacatagatcaaccaaccagcggttacaatgtcagctgtccccgagctgctgctgggtggtggggaggggggccctcacctgagcaccttgtgcgtgatgtcgtcatctgtgatcccgctgtaagtcaggtcctcattccacacgggattcagtgtgttcctctgagtcttcgtttttagcttattggcctgggatgtggggatgaaaggttctcaatacctgtcctccagccccacaggctggagtcatgggctgggccgggcggggcgagaggaggctgttaccttacaggctccaggcagcaagtgcagcttgacgtaggggtcggcgaggccattgaaatccatgggcttgaggccctggagaggagggcaggggagagggctagaggctcccggcacctctctccatccctcttgtagagctggaccctggaggagcccagaaggagggggcaagggcaggacgaaggagcaggcctgggaagggaaggaggaatgggccccctctgggggctgcacgcaaaccgggcccgggcttgggtggcagggagtgcccaccttggccctgaggatgctacagtgcagagtgcaggaggcccggtcgtagagaaggtcaaactccagcgtgcctagggcggctggagagagaggaaaggcagcatgggtcggtatggagacaggtgtgtgcgagaggccagcaggtgggcactggctctgtgtgtctctctctcttgccagcccgcgagtgtgagtgcaagaggctgagtgggcccatgcgtgtgtgcgtctgggtccctggctcggccgcaactggggctgtgtgggtggtggagtgtctcagcagaaatactgaatattgagccttgctgaagctgtaatctccacgctgactgcagctgtggtggccgtccctgccacccccccactgccctcctcccctacctacatgcacagccagcagggcccatccccctctccccccaccacggcaagcctggagacccccaccagcacatggggcctccaagcccccagactcactggcatcatccgagtcatagctgtccacctccgcaccatcctcaggcgtggtggccccaaggagggctgcagggggggccagagccagggggaccagatgggcgggggcctccccgccgcccccgccgcccccttcaggtcctggtccccgggggaagtagtcagagatctggcggatgggccggatgggcccggggcacacgttgatggccatgtgctcctggatgttgatggtcatgcgatcgcccctgcggcccctcatgcagcacccctggctaggagagggcgtgtgagccagtgagcccatcatacctagccatcctggctgagggccaggcgacggcctcctcggtctgtggggccctcactggcctcccttcctaggtgtcgagggagagggtggtgtgtgccagccggtggcaggtgggaggcctgggccctgcagaccccaagctgactccacaggggctgggctgccaacccactccttgcagaagtcgaggttgcaccaccccgtcctcacccacccacttctaggttgtccctgtatcatcttgccagctccttcctctcctccggggctcccctctgctcctgagcctgcctgtcccccaaggggccctgcagggccccgcctctgtttctcggaggctctgtcctcctctgcaccaggcgctggtctagtcagggtgtcacccacccctctaggctccaactgcccactgtcccctcattcagccccaggacctgtctgcctgcctggttcccccgctcgctcaccacagcccacggtggagaccccagcctcagatgccacctctggctcctcaggggagccagaaattgcagccgcaggagagccgaacacccccgtagcgcacacaggctggcacgcttccccgcaccctcacgcccccggcctgcccagccccctgcacctgcctctgcctccaacaggtgcccaggcactggggggacggcgggcgcaggctgggcggcggcggccggcgaggagagcgcggagtcgagctgtgcgagccgagagggagggagcgccgagaaagtgcggggaggagggggtgagcgaggtggaggcgaggatgcagccggcgcggcggcgggggacggggaggggcgctggggctggggagggggcgggatctcggactcccacccggggcccgctcgggagcgcacgcgagcgcgcacacacacgtgtgctcgcgcgcgcacactcacgcaggggcacgcggaccggcacacactcgtgtgcacacatccaaccgggcacccccgcgcgcacacgcccgtgcccacgtgtgcacgctcacacccttgcacacacccaggcgcgcgctggcacacttacccggagaacttcgcacacacacgcactcgcaaacacgcgggctccctgcgccaccaggaagcagccgccagaatcgccgggtgttccccaactactcctgggagacctggccccccgcccccgcccgcgcgcgcggccacggcgcctccctccctcccgggtccccaaggccggaccaccggcctcgttgtcatggcgacgccggctcatctccccccacccccgcgcgtcttcacgcccctcccccgcagggagctggggcctccctcctcccttccccacgtccgtagggacccacaggttgacaggagcagggggtcgcctgctgtcaccggccggggatctcggggtctcccgagccaggctggggagcctcacgatctgagggaggaggcagaggtctgatgctgcggcttcccccacgccccctccctttggccgttcaggcctctctccttgtggcccaacccaactcccaggggcccatgtccccttaccagggatggtatctcctttgggaaccaccctcccccctgccatccccagttctgccccgcaggtgggaaggggcgtcggggcttggctctgaaggtctcagagccctgcggtagttccccatgggctgccatttctcacccaaaccttgccacccccaagccgcccccctgcccggccctgcgcctgccacggagtgtcagtccacccctggccttcggtcttcactcacctgtgccccaaacttaccatcccgaagacacgaaggggcttatcaccctcgctgcccaccactgactcacccaaccgtttcctgcagttcctgggacacacctagacggctcaggcctagggatcttggctcacatgcgctcctctacctgggaaccgcgcttccttaggaagtcaccgtgggtcccctcttcctaggagccttcctggggcatcccgcactgcccctcagctccagcgccgtcaggactcggctcagcaccgcttcgccagtgcctcccccaccagcagggagttccactggagcggctgattcatctgggagtccctaatgtcccaaactgggcctggcacgaagtcggcatctctaagtgctgttatttaaaacagcaatctggttgcacgacaactgaacatacctaacaccacctaatcttacccttaaaaatggtgaagatggtacatttcgatatgcgtatttcacggcaatttttttttttttaaataagagaaatggggccgagagtggtggcgggtgcctgtaatcctagctactccagggactgcggcgagaggatcgcttgagtgaagccagcctgggcaacacagtgagacacagtctcttaaaaaaaaaaaaaaaaaaaagtaagagaaatgtaaagtcaacaacactgagggggcggggcgcagtggctcacgcctgtaatcccagcgctttgggaggccgaggtgggtggatcacctgaggtcaggagtttgagactagcctggccaacatggtgaaaccccatctctgctaaaaatgccgggcgtggtggtatgtgtcttgggaggctgaggcaggaggatcgcttgaacccgggaggcggaggttgcagtgagctgagatcgtgccactgcactccagcctgggctgtaagagcaaaactcagtctcaaaacaaacaaacaaacaaacaaacaaaaaaccctgagatatcacttattacccataaaatgggcaaagccaaagtgtctgggctggggggaagctgagacggactgatcccttgagctcagaagttcaagaccagcctgggcaacatggtgaggccctgtctctacaaaaaaaaaaaaaaaaaaaaaaaaaaaatccaggcatagtggtgtgtgcctgtggtcccagctactcaagaggctgaggtgggaggatctctcttctttttttttcttttcttttttttttttttgagatggagtctcgctctgtcgcccaggctggagtgcagtggcgtgatctcggctcactgcaagctccacctcccaggttcatgccattctcctgcctcagcctcccgggtagctgggactacaggtgcccgcctccacgcctgactaatttttttgtatttttaatagagatggggtttcaccttcttagccaagatggtctcgatctcctgacctcgtgatggtgggaggatctcttgagcccagaaggtcaaggctgcagtaagctataatcactccactgcactccagcctgggtaacagagtgagaccctgtctcaaaaaaaaaaaaaaaaaaaaaaaatccttagacccagaaattccacttttaggattttatcttacagatatgccaacccataagccaaataatagaagttcaaattctttttttctttttttttttttgagacagactttcactcttgttgcccaggctggagtgcaatggtgcgatcttggctcaccgcaacctctgcctcctgggttcaagcaattctcctgcctcagcctcccaagtagctgggattacaggggcgcacgccccacacttggctaagtttttgtatttttagtagagacggtgtttcaccatcttagccccgctggtcttgaactcctgacctcatgatccgcctgcttcggtctcccaaagtgctgggattacagctgtgagccaccgcgcctggccatgaagttcaaaattcttaaatgtagcacgttccaaaagactggaaacaactgagatacccagaagcaggggaccagttaaatcagtcatgatgtaattccatgcagtgaaatagggtgcagccacaagaggctgttttgctcttgtttagaatcatctttttttttttttttaaatatacaaggtctcactactttgcccaagctggtctcaaattcctggactcaagcaatcctcccgcttcggcctcccaaagtcctgggattacaggcgtgcgccactgtgcctggccctagaatcatttcacagtttcattttaacttagaaaagccaagtgcaggccaggcgccatggctcacgcctgtaatcccagcattttgggaggccaaggcgggtggatcacgaggtcaggagatcgagaccatcttgtctaacacggtgaaaccccatctctactaaaaatacaaaaaattagctgggcgtggaggcgggcaactgtagtcccagctgcttgggaggctgaggcaggagaatggcatgaacccaggaggtagagcttgcagtgagccgagattgcgccactgcactccagcctgggcgacagaacgagactccatctcaaagaaaaaaaaagcaaagtgcaggctgggcatggtggcttacacctgtaatccccgcaatttgggaggccgaggcgggaggatcacgaggtcaggagttcaagatcagcctagccaacatgctgaaacgctgtctctattaaaattacaaaaattagctgggcatgttggcgggcacctgtaatcttgggaggctgaggcaggagaattgcttgaacctgggaggcggaggttgcagtgagccgagatcatgccactgcactccagcctgggcaacagaacaagactccatctcagaagaaaaagaaaaaagaaaaaaaaatcaaaaaagaaaagcaagtgcagagaagcatgcttggaatactgccatttgagagggaaagagcttagccgtgtttgcttagttgttcatatgttgtttctggaggcctgcacaagaatggtaactgtgtctcttgacaagctgagagagtgaaaaaataaaaataataataaaaaaataataaatacacagaagaaaatataactatggtgacctctggggagacagggcaggaagaggaaagacttacttttcaacgtacatccttttgtattttttgaattttgtgccacatgcataggttacctgttccaaagaatacattaaaataataaattttggtatttctttgtttgtttgtttgtttgtttgtttttgagatggagtctcgctctgtcacccaggctagagtgcaattgctcgatcgcggctcaccgcaacctccgcctctcgggttcaagtgattctcccgcgtcacactcctgagtagctgggattacaggcacccgccatcatgctcggctaatttttttgtatttttgtagagatgggttttcaccatgttggccaggctgatcttgaactcctgacctcaggtgatccgcctgcctcggcctcccaaagtgctgagattacaggcatgagccactgtgcctggccaaattttggtcttgtctttttctttcttttcttctttccttccttccttccttcctttcttccttccttctttccttcctttttctttttttttttttttttgagacagggtctcactgtgttgcctaggctggagtgcagtggcaagatcatagctcacgacatcctcgaactcttgggctcaggcgatcctcccactttagcctcccatgtagctgggactataggtatgcaccaccatgcctggctaatctgtttttgtttgtttgtttgttttgtagagatgggtcttactatggtgcccaggctggtttcaaactcctggcctcaagccatcctcctaccttggcctcccaaagtgctgggattacaggtgtgagccaaagaccatgcccagcacaataatatatatatatatatatatatatatatatatatatttttttttttttttttttttttagacagagtctcgctctgttgcccaggctggaatgcagtggcacgatcttggctcactgcaacctccacctcccaggttcaagcctcagcctcccaagtagctgggattacaggtgcacaccaccatgcctggctaattgttgtatttttagtggagatagggtttcaccatgttggccaggctggtctcgaactcctgacctcaagtgatctgcctgccttggcctcccaaagtgctgggattacaggcatgagccactgcacccggccaatatttctaaagtaaaggcaaccgttaggtttccttcgtggctctccagaataagaaaggaagcaggacgaagggagacacagtgcagtgtgaaagccggtgagtttagcaagagggtgtccatgacctgggcgcagggggcctgcagtgaggggagggggacactctggtcaaggaacctgtcgagtcctctctcctgtgctctcttcccacggtgcttgctcaaccccagccctgcctgcctccagaagaacttgttgaagacaggtaaggatgaggctggagttcaagccaatttcagaggaaaatgatggacagtgctgagccctgctttgtccagagacgggaggcttttgcaccagtcacccagtcattcagtaaatattgactgaatatcgactatagattgtggggatacaaccaggcccaaggtcaatgagctgtgacttcacagcctcatagggaagacagacaaatacacagacaatccccatccagggaaactgacgtggggacaggggatggtcagaagccatgggaactcagggtcctatgaggtaggagggaacaaagattaacacctcacttcccagaaaaggagttgtctcaactgagacctgaaagatgaggaggagttacccaggtcaagcttgggggcaagtgtattctaggcagaggtgtgtgccaaagctgggaggcagtccagagtacggcatattcagaaaagaaatcattctaccagcctggtcaacatgacgaaaccctgtctaaaaaaaaaaattagccaggagtggtggtgtgcacttgtagtcccagctactcgggaggctgaggcaggatgatcgcttgagcccaggagtttgaggctgcagtgagccaagatcaagccactgtactccagcctgagtgacagagtgagaccctgtctcaaaaaaaaaaaaaaagagaaaaagaaagaaagaaatcattccaccaaaaagacacctgcacttgtgtgtttattgcagcactgttcacaataggaaagacacagaatcaatctaggtgcccaccaacagtggactggataaagaaaatgtgatatgtatatgccatggaatactatgcagccataaaaaagaatgaaattatatcccttgcagcaacatggatgcagctggaggccattatcctaactgaattaatgcggaaacagaaaatcaaataccacatgttctcgtaagtgggagctaaacattgggtacctatggacataaagatgagaataacagacactggggactccaaaaaaggggagggagggaaagagtcgaaaaactacctattgccgggtgcggtggctcatgcctgtaatcccagcactttgggaggccaaggtgggcggattgcttgaggccaggagtttgagaccagcctggccaacatggcgaaaccccatctctactaaaaatacaaaaataattaagtgggcttggtggcatgcgtctgtaatcccagctactcaggaggctgaggcacaagaatcacttgaacctgggaggtggaggttgcaatgagctgagatcgtgccactgcactccagcctgggcaacagagtgggactctgtctccggaaaaaaaaaaaaaaaagaaagaaaagaaaattgaggctgggcgctgtaatcccagcactttgggaggccaaggcaggaggatcccttgagccccggagttcaagaccagcctgggcaacatagtgaaatcctatttctaccaaaaaaaaaaaaaaaaaaaaaaaaaacttagctgggcatgatgacttgatgatgcagtcccagctacttgggaggctgaggagagaggattgcttgagcctgggaggtcgatgctgcagtgagctatgattgcaccactgcactccagcctgggcaacagagtgagatgctgtctcaaaaaaaaaaaaaaagaaagaaagaaaattgaaccaacagatctttttattcttatcttttacagatgggattctctgtcacccagcttggagtgtagcagcacgatcatggctcacttcaaccttgaactcctggcctccagtgatcctcccacctcggcttcccaaatttctcggattacaggcatgagcccccgaacctggcctaacaggtctcaatttggggttcattaggtgagagataaggaagcaggatgattcctaggtttctgtgttgagcagaccatctagaggaatgatgggaccatccactgagacgaaaagatgggagcagagcaggtctggagtaggactccatttgtgatccattgccttggagatgtatttggacatcacaaacagacatctcggagtctggagctccaaggagaggtctgggctggaaatatacatttgtgagtcactggcatatagatggtatttaaagccacgagtatggatgagatcacctaggcagagaatatagatagcaagacaaggccccatgctgagttggctggagaaggagtcctgagaactggtgagtgtggttccagggctctgagtcagggacaggtgcacctgctgggaggcagacggaatggaaagagagagaaccatttgatttggcagattatgagctcttttgtggacttgatcaaagcagcttcagtggattggtggggactaagccagattagaagaggttgaagaattggctgggcgaggtgactcatgcctgtaatcccagcactttgggaggcagaggcaggcagatcacctgaggtcaggagtttgagaccagcttggccaacgtggtgaaaccccatctctactaaaaattaaaaaattagctgggtgtggtggtgggtgcctgtaatcccagttactcaggaggccgaagtgggagaatcgtttgaacccgggaggcagaggttgcggtgagccgagatcgcgccactgcactccagcctgggtgactgaatgagactccatctcagaaaaagaagagattgaagagtccattaaagatgagggagtggagacagcaggtgtagatgacccagagttgcccgtctactctagaatgatgcgcatctatgagttctctcccttgtcattcttgaggtcagggaccgtgccgtggtgatttctgagtcataaatggagtccagccagtgcgtagcaggagctcagcacgtttatgtcatggatgaataaatgggtgaatggataatgcattgtttgggtcaaaatggcctttactagtagagatagcttaatgtttttgaagcatttgaggaaacaaaagaaagtcaaccccaaaggccataggttctgtgtcccttctcccagctaacctcaaggagcagttgcctgtgggcctggggcacgagccctggcccagcgtcgggaaccaggttatttatttattgagacagagtctcgagtgtcacccaggctggagtgcagtggtgcgatcttggctcactgcaacctccacctaccgggctcaagtgattctcctgcctcagattcctgagtagctgggactataggcacgtaccaccatgcctagttaatctttttttttttctttttctttttgagatgaaatttcaccctgtcacccaggctggagtgcagtggcgcaatttaggctcaccgcaacctctgcctcttgtgttcaagcagttctcctgtctcagcctcccgagtagctggggctacaggcgcatgctaccgcacccggcttatttttgtatttttagtagagacgtggtttcaccatattggtcaggctggtcttgaactcctgacctcaggtgatccacttgcctcggcctcccaaagtgctgggattataggtgtgagccaccgcgcccagcctttttttggatttttagtagagaggagatttcatcatgttgggcaggctggtctcgaactcctggcctcaagtgatccacccatcttggcctcccaaagtgctgggatcataggtgtgagcaccgcgcctggcccaaaaaccacattactgagtcccttctgctgcctctcacatgccttgtggctttggataaatcccttcctttttcttagaagtgatctgcatggcggctcacacctgtcatcccagcattttgggaggccagggtgggagaatcacttatgcccaggagtttgagaccagcctgggcaacatagcaagactccatctctgcaaagaaaaaaagaagtaggctgggcgcagtcgcacacgcctgtaatcccagcactttaggaggccgcggagggcagatcacttgaggtcaggagtttgagaccagactggccaacatgatgaaattccgtctctactttaaaaaactacaaaaattagccaggcatggtggcatatgcttttgatcctggctactcgggaggctgaggcaggagaatcgcttgaaccaaggaggcagaggttgcagtgagccaagatcgtgccactgcactccagcctgggcaacagacagagactccatctaaaaaacaaaacaaaacaaaacaaaaaataggcaggtgtggtggtgcacgcctgtggtcccagctacttgggaggctgaggtgagaggatcgcttgagcccaggaggtcgaggctgcactccagcctgggtgacagatagagcaatatcctgtctcaaaaaaagggaagccatcagcgcagcacaggggaagcagcccacgtgagccagtcccatagatattcgtttccctccttccccacccccgccccgctgccccctttttttctctctctgggctttttacttgtttaggaactcgaagcggttcatggcaagtaccccgagtcctagcccacctgctctctgcatagggttgcggcagagcacctcacacgcgcagatacacgcctggctttaggggaagtcgcggcactgggtctgcagagtccgctgagcacgcaccttcgttgtgaaactaaggaaaccctggagtgtccttgggcttgggtgggatggaacatgcccgtgacagacaggcccacctgccaatcagaagggcgctctccttagctgggatggggccgcaggagtggaaatggctgttgggaggtggcagagatgggagatggggtggccacgggggagccgccggccacagaagaggaaacggaggtgcagggagcggagtctgcgaaggacgcgtggatggccaagagatgtgcctcggaaagggccgagggacttcctctgaccaacccccgacggccattcccagccatccgttttcctgcagccgcggatgcaacctgtggaagaggcgggaggaggcccgggagtccgccccgctgcgcctttcctagggtgggagcgtggactcaggcgcggccgctgctgccacctagtgggagacgcctgctactcctctcggttcctaaccccagggtcgttcccggctgagcactaaggagggggcgggggaggacggagagagccctgtgcccctggatctgcggataggatgcaagggggagcctcagagaggaaccccccccccaggaagtgtgcattgcccacactacttttcccctctgtgccgtgatttcctcccgtgtataagggaggcaagagtacctgcctctgggctgggcttggtggctcacgcctgtaatcccaacactttgggaggccgaggcaggcggatcatccgagttcaggagttcaagaccagcctggccaacatggtgaaaccccatctctactaaaagtacaaaaatcagccgaacagtgatggtgcgcgcctgtaatcccactccaggaggctgaggcaggagaatcgcttgaacccaggaggtggaggttgcagtgagctgagattgtgcgtctgcactccagcctggcggacagagtgaaactccatctcaaaaaaaaaaaaaaaaaaaaaaaaaaaaaagagtacctgcctctgagggtcagtgcaagagcaaatgaacaaatttgtgcaaggtacttggccataaatggggtccagccagcatagtaataggtgttcaataaatgctacctgctgggcatggtggctcatgcctgtaatcccagcactttgggaggccgaagctggaggatcacctgaggccagaagttcgaaaccagcctgggcaacatagcaagccctcatttctacaaaaaatgcaaaaattagccgggcatggtggcacatgcctgtggtcccagctactcaggaggctgatgtgggaggatcacttgaggccaggagttcaaggctgcagtaatcataccactgtactccagcctgggtgacagagtgagaccctgtctctgaaaatacataaaataggccgggcgctttgggaggccgaggcgaacagatcacctgaggtgaggagttcaagaccagcctgaccaacatagtgaaaccctgtctctactaaaaatacaaaaattagccgggtgtggtggcagacagataaaaggaagggatttatccaaagctgtaatcccagatactcaggaggctgaggcaagagaatcacttgaacccaggaggcagaggctgtagagagccaagatggcgccactgcattcccacctgggtgacagacagagaccctgtctccaaaaaaatgaaaataaataaaacaaatgttacctgtggttgatccaaggggtaaccggaggtgtgtggccctgtgccaccaccccaaattgtgcctgttgtccaaacacagcttcctttagttcgggctttcagcaagatggccgtgccgcatccctcctctttgtaaatgctggggctgccaccattatggttttatcatcagcgacattccagggggtgaagactggtcccaacctctcttctcctctcctcttctgatgagagtgagggatgggggaggggtcccagctcctagcactttctcccctcaccccaaagtgccatcagaacagctctgggctgtgacatcacagagcccccacctcatgataggagtcatgaggctgtggccatgggtgctggtgtgggtgtggctggctgcactaggggccatagaaactggtaagaagctgtcttgggagcagcaggaaggcaggcagctctgggagcataaagtgtgatgcccacttagggactcggaagccaaccctgcaccctctcattttctctccactcttctctcccatcctgctggtcccacctaccccccaacaaccgcgagccttgtcgtggtgcacccagctgaccctgagggaaatcaagaccctccacagcctctgcaataaggctgggtggtctcacagggtcccaagtcagcttccgcctcgagagataaaggcaggggtcagcttggctgttgtcacagagtttgcttgggtcctagcacccagacccaagcgtgccacggcgtcagccctggggacagagtctccgcgcttcttagacagacctgacttcttcgattatccggactcagaccaagccaggctgctggctgtggcccagtttattggagagaaacccatcgtgttcattaactcaggtatgaaccagcttgagaagggacctccctccccgccagggtctggaggagagcagccccagacccttcattgggccatcagaggggagttaagggtcctgtttgtctagcaggttccagccccgggctcttccatcacatcctggtgggcttgctggtggtggcgttcttctttctccttttccagttctgcacccacatgtaaggcctgccccctttctccaaccccacccaccaccaccttccttgggagcggctgaagaccccagttctagcggggcaggctgtgacctctcccctctgatctccatgccccacagaaacttccagaaaggggcctaaagagccggacaagggctctggactcaacctgagcacccacacccacctcctctcctgttgatgagcaaaagttccctgctttcctcctccctgactgcccagcgagcagctggggatcctgtcccctctgtttcccatggcccaagccccccacctcctcccttcccagccccaaagaacttggtggcaagggccttggtggcgttcacgcagatcgtcttttattagcggtctgtaaagcacctcccagggtcccccgaccccagattggaggaagccttgagaggtcagtagcaccagggacatggcagggcccgagggcgcgatgtgcagccgatggtgagggactgggcgccctcgcctgcccccggggttgtcagcactgggaaggcttgggggtagcagccacctccttcccccaacccaacagactagttcaaatttgggtaaataaataaaataaataagattcctcaagctggcctaccctggagaggagccgtggttgcagccggccactcgggaggcccgagggccagcgggggttagttggggcgtcctctcctctcgggtgatggggagccctgggggatggcagcataggggctgggatggccttggcagaggcgtctccccacattctgactcctggtccccttgaaaccctgttggtgtccctccccacaagccctcctgccctcagtgggtgggaggcggtgccccctcccctcctccagcgcaagggtgtgcaggaagggggcagagtagggggaagaggtcccctctctccaccccctcagtccccgagagatggggcctcttccctttcggggtcatcgtcagtcctggggttgtccgggcaagaggaccctggctcccaaccccagccatcagccccagagccctgtctccacgggggtgggggtggggagggggagggtcccggcccccggcctcagtcctgggcctggcaggccgggggcggccgggagcggggccagaagaggcggcaggccccacggcagatgaggaagaaccagtagagctgaggggccaggagcagcgcagcgcccaggttgacgtgggcagggatggccaggggcacggccagcaggggcaggccggcatggcgcccgtaggcccagtacaggtagggaaagagcagcacccggcagcagaggaagctgagcagcatcagggccccgttcaccttgtgcagcagtgtgtgctgctgcttgtactgaggagacacagacacagtggccacggcagcagaagggctcggccccccttggccctctccctgcctccctgcgaccctagcaggcagctcctcccaaaccagacactttgccaggacacaagcaccaggtgctcaaaatgcacggggtgagggggggatgacgaaggggctagagcccttggcagcaaccttgaaggtccctccccttcctgtgacctccccattgggctcctgcaccctcccatgctcactcacctggatgaggatcttgccaaggcagacgaagggcgtgctgacctctgccatcaacatgcaacccagaaagaagtctcccttaccctgtcgccacacctgggcacagaggcaggaaggtgaggagctggggctctccctgggttcttgggcagcccccgcccttcctctttcccctctgtcactttgggagatgcttgactctgaacatcagaacacctgggtgcagggctgggtgcagtggctcacgccggtaatcccagcactttgggaggctgaggcaggtggatcacgaggtcaggagtttgagaccagcctggccaacatggtgaaaccccgtctgtactaaaaataccaaaaaaattagccaggcgtgttggtgggcacctgtaatcccagctactggggaggctgagatgggagaatcacttgaactcaggaggcggaggtttcagtgagccgagatcacaccactgcactccagcctgagtgacagagagagactccgtcttggaaagaaaaaaaagagaaagaacacctgggtgcaggagcaggtgcatgacttggctgcatccctctcacggtcctgcagaaagactgtgtcccttatgtaacaggtgaggaaactgaggctcagagacgtgcaaccacaaatccaaagagccacagccgggcatcgtccagcccagggccaggctgcccccacaccctggtgccctgggctggtgctcagtgaaccctgcctgtccacagctttccctgggaatacgctgggtctgcttggttgtcagtacgcagacccggggcttcccaggctcctgccagcaccagcaggaccaaggagcaggccacccgcaccccgcccgcccagctccccgggactcaccactgagagtgggaagcacaccagcaccatggcggcatggtggagcaccatgaggaactccttgtgcaggtagccacgcgctatggcccacgtgctgcccggggctctggccgctccgtcgtcccctccatgccctttgacctggtgcttgtgccagtgacagaggaacatggcgtagatgtcgtagatgaagtagggcacagcaaattgcgtgtaggcagaggacagccagtgtctgttgggcagagagacggggtgggggagcaaggaggaaaggggacaccagtgattggggtcagatctcaggggtcagcacagcagccctggacaggagcggagtcttgggtacagatgagggatccagagggtagagggtgagaaacttgcccaaggtcacacagtcatgcagctagtaagagatggtgctgggattcaaacctgtggtctcagaactcacccatgttcctctctctctgcagtatagtcgggggaaaagaaaagaccagaagatgcccacagaccaaaaggcacagatacagtgccaaaataagcccaggacaggcaggtgggaccttgccatggttatttgtcctaaccttaccatgaggttaggaccagcaacagctgaaggggcgagagtgctggagagagaggtcacaggggtggacgcccattcctgcctcctgggacaggcgatcttccaaacttcccatgcatagccttatttacccctcccaaaaccctgtaaaaggtaggtgtggccatcatccccactgtacaggtgaagaagtgagtcacagaggggctaggtaacctggccaaggaagggacatgggcggtgtggctccacagccctcactgtcatccccaccatccccagaagatccgagaggcatcagagacagaccctgttggcaagtgagaggtcttgtcagcgctgttcgccctgccccaaagtcacccaatctcttgtctattttgtgttgtttttcagggacagccaagcgttaaggggaaaatgcagagcaaaaggagccaaggacaaagaaagttccatgtacttggagagtaaacaaaaacgagaaatggatgaatagacaagacagcatttttcttctggagtcagcacattggcagtttctcttaaatcctgtagtcccaagactggcctggggtgggggcaggaggtcagagaggcaggacctggggtgctcgccccacaaggggtggagggatgaaagcagagtcagccagaagccatcaccaaacatgaggcacgtggaggaggctgtggagaagttggggctgaggcctctgaggatggggagcctgaggcaggcggcctgtgagtggagccaacccattctccagcagggacggtaccagggaaaagggaacctgagactggtgcagtggtgtggagctgcggcccagaggcagggaaagatgagaggggaggggcagctgtagagaacgcgaagcgggaacacagggagagaggtcccaagtggcctggaggagtcagggcaggaagctgcccagaatgcaggcccagcagaggtgatgggagatgggacagctgggctggtgcaggagaccaggaggggccaccaggccctgggctgtcatgtgaggtgttagatcccatccccaccctcttggcaattaggtgctcagaagtaggaacagctgctgccctggattaacccggatcctccccacctacctgaggattaaagcagggaagacggacaggaacagacacaggggggcctggggagcagggggtacagaagctaaacggtgacctctgcatgtgaaggctggggaggaagtgctggatcccaggctcagcttggagcaggggagggaaggggtgggcagaggccaagaagcagccaagtccctgggcggggtctgaagaaagagttaagccaagaactgtcctctgcagctgccacttaactcaattcctctcgctgaagcccttccaggaagggccgctgcctcaccacagaagaggcaactcatcttcgggaaaagaggaggcaaacagaaacagggcaccccccatcaggggcgtccaaatgttccctgggactcagtggctgccacagaagggaagcggtgctgaaagctacaaagggggcgttgtgggcacctctaaggcaacttgcaacgggccacccgtgggtcacctagggcggccgtcagcaccacggacagggcccctctcctccccgtccccccgcctcctgcctgcacacctctgggcctttttggcaaccaccagacactgcagcagctgcctggccacattttggcctcttcaccctcatcccctcccgcactgcctggccgtgtgtggccttgtgcgtgtcatctctcccttgtcctctccctcaggcatggagtggatgccggatgcctggattatgggaagggctgaggggtgagcctggcatgaggagggggcaccccatctgggtgctggctggaaatggggtctgcctcctggggtggaaggcagggaggaggtggggaaccacgacaacacgggagacctggaagccgactagaaagcgctttgaggatcctctctgatccccgctccttctccccctggttctgacctttaaggacaggacaggataaatttatccctgggtgttgagttgcggttattgcagttaacttgctcaggcccaagttaagggcttggggaccacagacagagttccctccaagatgtggggtcttccgggattacccgtacacgccaaccactggcacctgggcaggggggtgtctcgcagcacttactggtcatcaatgatgtgcttgcaggaggtggagacgatgtagccggcagtggaggccatgatggcctggacagaggacaccagcctgggggagagagggaggcgtgctagaaaggcagaagggaagaggcgtgtgccttgatttctcctcgttgctagtctaacgactgcgctttgcgttcagccacttctcgggccagtccttgcctgccttcgcccaaggctgggctgcctgaggtgtgccccaccacaggtacctcacggctctccggcccgctcggctgctgttcctcagtccaccccactccttgccaccttcttccttccccatttgtggaaactgagtctccctcttctcaagcccgcagggtgtctgtcctgaggtgagactgagagtgaactgctggcctggacctctccccacgaggggagcctgggccggttcttgccccgcttagctgtccagtcatgacgcaggcctcactctggaccctttgtgaccccgagttccccagtcactttcccactgtctcctgactgccaccagcctccactctgcactctggccctgttctaggggtgtagagttgtaccatccactcctccatccctggcccccaaacactcaccctgaatgacacctagctgtctggccctggcctcagtccctaatgtcttataggaatgtcttcgccgcatgctggccctgttttggagggtgggagggtgtacggggaagaagagagaggcgggctgaacactagtagaccagatggccgggctggatgaggtctcccagaacagtgagcaaggcaggcagtgaggagagaggaagcctgggggtaaagccccggacccccacaggagctcccagtcccccaccgctgagggtccagagaagtgccaggtcccttccattccctgagaagcccaagaagcagacaggggctgaggggaaagaaagtggtttacctggctgagacaatgactgcgtcggcctcctcccagcgtagctggggcagccgctggagcgtgttcttggagaggaggaagagtccggggaacaccacccccccggccaccatcggggtcagcatggtggctcaggacttgggcagggaggcaggcgggccgtgaaggggcagggaggccgagtggaaggagttaggggtggagaagggacgccaagcccgggaaggagggagaaaacgatgagaaggggcacaaaggggccagggcggggacgggatggggccagggagtccgatgaaactggggagtcgggagggggctggctgggcagagacgggggaggggaggatgggagaaggggagcaggagcaggccagcgagggatggggagaggcaaagaggggatggcttggtgagggacagagaggaagaggggacaggaggaggaggatgcggatgggggaggggagggagccaccaggcaggtggggaggggaggcttacgtgagaggctgggagggcccgaggaggcggggagggggtgggggtgggtctgagtaccagccccaaaggaaggaggtgggcgggagggagcggaggagcagccgggcaagcggtcagcggtcaccaccgctctcctggctccactgcctcctctcgctgccgccccagtccctgccgcccggcacagacaccgcacatggcatcatcatagagactccgtgcccagccccctgccccctcggtggggagggggagggggaggggaagtggccagcttggggaggacgggggaggggcaggaaaatgatggcaccgaccagacaccgagaaaccggacctgcagcggcgtctccccatgcagctctgagccacagccgcggctgcgacagagatggggggagcagagaaagagggagggggaggcccttaaaggaacagcagctgcggtggcacagggggctgctggggacaggggacaggggccagctcttctcttggggaggaagggggcccagggctccttggccagctgggagggggccctgagcccccacaggggcctgaccctgcttcccatcagcactttgcaaatgcctggcatctcctccctcaccaagccatccctctgtggcctgccccgggtccgagctttgggtggccattccagcggaagagagcgttccctgggagagggagtaagtggtgctttctcagaaggaagagctgaaggaggggataggagcaaaaacatctcaacacagcatcctcagagccagaggccccctcacccgatggcggggaaggaagctgacattggccagagggggcacctgactgtgctgcagggctgcccatgtcctgtctgctgcaggagctccgaggtcactgcgtctgtccttcccacagggccatcaacgatcctgaggctccctgaggtcacccagttcagaagtggcacagccctctcattgcaggcgttggaggggcaaggagtggaagaaggggaaacggtggcgagagcgcggggcagctgcctctcaggaagtcccagggagccctaggatgcccaggccctgttcttcagactgccagcccctcctggccttctctaaattcccacccctcactttttcctcagtttccttaatgctactagctcccctttctctgcaacttccacatacagcctagtttcagagtgggaaaggactgcggggtgggctggtgcaagctcctcactggcccataaggaaagtgaggcctggggactgggcccgggtggagctgtgggacctgagccagagacactgccccctttgacttctggcctcccatcctgctcccaactgtcctgtggacttcagcatgacaagggcctgttatgcaaactcctttggtctccaagttcaatagtcaaccctatggtttgcctttctctgccagagcccactcctcgcctcccccaaagaaaggccagggactgggatttgctgttttgtgctgccctctagcggcaatctgtaggaaagcacccaagaagtctcacgctgatttagagacggttgtagagacaatagcggacctagctcctgtcctcagcccttcacgggagggggaaaggggatccagctccctgagtttttactacatgctgggcacagtaccaggtgatttctactggttcttacttggtatccctgttttacagaagaaacaggtttagaaattttgtggggttttttttttttttttttttttgagatagggtctcattctgtcccccaggctggagtacagtggcgcgatcatggctcactgcaacctcaacctccccgggctgaaatgatccttatacctcagtatccccagtagctgggactacaggcgcacaccaccatgctcagctaatttttgtattttttgtagagatgaagtttcaccacgttagccaggctggtctcaaactcctgggctcaagcgatccacccacctctgcctcccaacatgctgatattacaggtgggagccaccacgcccggatgaaagctgggtttcaaacccatggttgcagccgggcaaggtgtctcacacctgtaatcccagcgctttgggaggccaaggctggcgaatcatgagatcgagaccatcctggctaacacagcgaaaccccgtctcttctaaaaatacaaaaaattagccgggcatggtggcatgcgcctgtagtcccagctacttgagaggctgaggcaggagaattgcttgaacctgggaggcggaggttgcagtgagccgagatcgtgccatcgcactccagcctgggcgacagagcgagactccatcttaaaagaaaacagaaaaaccaaaaaaccatagttgcataaccccaaagccactcatgagcaaaactgcaaaaaggacagaggctggggaggctgggtgatgggcggccaccgtaactactcgattgaggactacaaggctggtcatggaactgtggtttcactttggatgagtagagacaggctttttttgtctgccagggaatccacgtagacaccctagtaaaatctgtgttccgtgtacctcctacgcctcctgtggtttgctgatactgcacttttatggtaagctttgtcacacaggtcatagatctgcagcccaagggcccaatccggcccacagacatgttttgtttggccagtatgcagttgtcagtatagtagttcttaaataaattcttagttacttatcagtattcaagaattggaagaggttgggcgtggtggctcatgcctgtaatcctagcactttaggaggccaaagtgggcagatcacctgagatcaggagtttgagaccagcctggccaacatggtgaaaccccgtccccgtctctactaaaaatacaaaaattagccggacgtggtggtgcacacctgtaataccagctactcgggaggttgaggcagaaatgttgcttgaacttgggaggtgaaggttgcagtgagccaagattgagccactgaactccagcctgggcaacagagtgagattctatctcaaaaaaataaaaagaattgggagacagcccaccacaatgacatgcacctgtagtctcagctactcaggaagccaaggcaggaggatcacttgagcccaggagttcaagaccagcctgggcaacatggagaaaccccgcctctactgaaagtacaaaaattagccaggcatggtggtgcacacctgtagtccaagaaactcaggagtcagcccgattctcagggagaatcacttgtcagggaggtcaaggctgcagtgaatcatggtggtgtcactgcacttcagcctgggtgacacagtgagactctgtctcaaaaaaaaagaagaggccgggtacagtggctcatgcctgtaatcccagcacttcggaggctgagaaggaacaatcctgtgagcccaggagttcaagactagcttgggcaacatagtgagaccctgtctctaccaaaaaaaaaaaaaaaaaaaattagccaggcttggtggtgcattgcctgtagtcccagctatggcaggaggattgcttgagcccaggagttcaaggctgcagtgagccatgatcgtgccactgcactccagcctaggcaacagagcaagaccctgtctcaacctgtctcaacaacgacaaagaatcataactccgaaaatattggcccacgttctaaccatataacattatcagtggctggagctgagcagcactggccctcagcagagaaggtgagtcctccagcctatatcatccctgcagagcccacagccctcatattatctgcagcagttttcaacccctgctctacagacgctgattcatatgatcctcacacaacatctccacgaagaaaggaaagtggggtgttattattaagcccatttaccagtgagggatctgaagttcagagaagttaaatgactcacaaaagaccccactgttggtgtctttttttctttttcttttttttttttttgagacagagtctcactctgtcacctaggctggagtgcagtggcgccatctcagctcaccacaacctccacctcccgagttcatgtgattcccctgtctcagcctccagagtagctgggattacaggcacctgccaccatacctggctaatttttgtatttttagttcagacagggtttcaccatgttggccaggctggtcttgaactactgacctcaggtgatccacctgcctcagcttcccaaagtgctggaattataggcgtgagccaccacgcccagcctgctggtgtcttttgactccacattccagctccactccacactctgcttctgctttcaccacaaactcattctgaaagtaaaagatcagttccaccagccatggccccaggaaggacaccctcaccctggtcctcttacttggatgctaccaggacagcctcttgtctctccatctgcaggttggtgtggttctgcaagccccagcgcagggcagtgaagcacaacgggaagaagacgcaacccactgcgaacagcagggtcatgcctgcctgcagccaagaaggcagaaaaagacggccatgagaacacctcaacacaacaccctcagaccccccagcagccttcttcacccccaatgaggcaagccccaagagacccatccatctgtggccattgaaagccaccaggcaaacctcttctctaagctcctagcatccttattactcttttaatattcctcatccggggcaattcgacatcctaattatcccaattttttgttttaaacactcaatttagacaatttcttttcttttcttttcttttcttttttctttttttttttttgagatgcagtcttactcttgttgcccaggctggagtgtggtggcgtgatcttggctcactgcaacctccacctcccgggttcaagcaattctcctgcttcagcctcctgagtagctgggattacaggcgcccgccaccatgcccagctaatatttgtattttcagtagagacaggactttactgtgttggccaggatggtctcgaattcctgacctcaagtgatctgcccgcttcggcctcccaaagtgctgggattacaggcatgagccactgcacccagctcctcctactcttaaactccaccattttccatcttctgcatgccccgcccgccgcccaccctaagtcacctctaccttctccccagtcctcacctcagagggacaggttggaagacagaaagggaggttgatgtttctcctcagcacccagaacttggaaaaaggaagggagggggttgtcaagatatttggaactttaaaatgacatttgttgaaaaaacaaaataaagccaaagcgattgttgttccattaaaaaagaaaacaaaagaaataacaggtgcaagcctgaaactacatatatttacatagatatcatttttgtttagaaagacctcccctcccatctactctggggagcagaggtgtggagcaggcacaggcaggatgaagggaaccaggtcctgccatcctgccttcctgaagtgtcttccaagggaccttctcgggataaaaggaaggtgtcaaactgcaaaggcacgaggctgctctgtagaggcagttggggagggcaggagtatgctcttccattggtggagtggctagaaggtgccatcctcctaatggcccgccagttgatacatgtgccctatcatttgcttcctgtgggggctggggggcggttccagcaagccttgcctagaattggccaattagaatccattggtgacttgatggacagctatgtttcagggacagggctcaaagaaagaaaaggagaggggaaataagagcaggtgcagggccgggcgtggtgactcacgcctgtaatcccagcactttgggaggctgaggcgagtgggtcacctgcggtcaggagttcgagaccatactggctaacatggggaaaccctgtctctactaaaaatacaaaaattagccaggcgtgatggtgggaacctgtaatcccagctattcaggaggctgaggcaggagaatcgcttgaacccgggaggcagaggttgcaatgagccgagatctcgccactgcactccagcctgggcgacagagactctgtctcaaaaaataaataaataaataaataaataataaaataaaaaaaaaacagcaagtgcagtggttcaggctggaatccccgcacctcagagaccgaggtgggaggatcacttgaggccaggagttcaagaccagtttgggcaacatagtggaacccctgtctctacaaaaaattagaataataggccgggcacggtggctcccgcctgtaatcccagcactttgggaggccgaggcgggcagatcacggggtcaggagatcgagaccatcctggctaacacggtgaaaccctgtctctattaaaaatacaaaaaatttagccaggcgcgttggcgggcgcctgtagtcccagctactccggaggctgaggcaggagaatggcgtgaacctgggaggcggagcttgcagtgagccgagatggcaccactgcactccagcctgggcgacagagcgagactgtgtttcaaaaaaaaaaaaaaaaagaagaagaagaagaataaaatagtccagtgcaatgacatatacctgtggtcccaggtacttggaaggatgaggcgaaagaatggaaagaattgcttgatcccaggagttcaaggctgtagtgagctatgatcataccactgcactccatcctgggcaacagagtaagaccctgcccccccaaaaaagtagtcctaagtaattattgatttaaaaggcggtgtaggataaaaggtaaagaaggccatttctactgtgggtgtacatggacttcaaattcagagtccacagataatcaaagaaacatttcacttccctattgctgaaataaagaaacaaataaagaaacacactgtatggctctgtttacatcaaattcagaaaagcaaaacatctatcatgaaaaatctgaacagcgtttaacttggggaaggtattgactgggaggagaccccagggaaccttctgaagtgttggaaatggccttatattgatcaccagtgtatacatatgtaaacattctcgaggcatcctcttaaaatgtgtgccccttaagtgaagctgcagtttttaaaattctaaatttaggctcttcctttctctgaatgatggtgggcaaagcctttatgggcctcaatttcttcatctgtgaggttgggttaataattagtgtcacatcattaaatgctgcttagactacaggtcagacattgatctgcattctctgactctaaaagaaaaaaaaaaggccaagtgtggtggtgcacacctgtagtaccagcactttgggaggccaaggcaagaggatcacttgaggacaggaggttgaggctgcagtgagctttgatcacgagactgcactccagccttgggccacagagtgcgactccgtctctaaaaaaatcaattaagggctgggcgcagtggctcacgcctgtaatcccagcactttgggaggccaaggcgggcagatcacaaggtcaggagttcaagaccagcctgaccaacatggtgaaaccccatctctactaaaaatacaaaaattagctgggcatggtggcatgtgcctgtaatcccagctacttgggaggctgaggcaggagaatcgcttgaacctgggaggcggaggttgcagtgagctgagaagccgagatcacgccactgcacttcagcctgggcgacagagcgagactctgtctcaaaaaaaaaaaaatttaattaaaaatatcaagtcatttatccaaagcaaccttgtgggtagggattattactgcacctctgttttacagatcagaaaacagaggcacagagaggtttggtaacttgtccaaggttaaacagtcaggaagtgaataaaaattttttaaaatcatattttctgaatttatttgtccctataatgttaggcagatatagaaaacataaacttattttcctaaggaactgaaaggcttttttaaaaaggagggaaaaaacaccactgaatacaatttagacatcctcattcatattttcagaacttatccttctcctcctccttcctctcttttttttttttttttttttttttttttttagatggaggttcgctcttgttatccaggtatccaggctggagcgcaatagcgcaatctcagcttaccgcaaacgtcgcctcccagattcaagcgattctcctgccttagcctcccgagtagctgggattacagccatgcgccaccacgcctggctaattttgtatttttagtagatatggggtttctccctgttggtcaggctggtctcgaactcctgatctcaggtggtctgctcacctcagcctcccaaagtgctgggattacaggtgtgagccactgcgcccggcttcttcctcatattcttttgagacagggtctcactctgttgtccagactggaatgcaatggcatgatcctacctcattgcagactcaaacttctggactcaagcaatcctccttagcctctgcctcagcctccagagtagctgggactacaggtgtgcacacaacactcagctaatttttgtatttaaaaaaaaatttttagctatgttctatggaaaggaatctttgtactttttatagagatggggtcttgctatgttgctcaggctggtcttgaactcctggcctcaagcaatccccttgccttggcctcctaaagtgctgggattacaggcatgagccaccatgctcggccagtgtttgcttctttagctactttattttcttccctctggatgggactctgaaaattaaaagttaaaccaagagcggccaggcatggtggctcacgcctgtgatcccagcactttgggaggcagaagggggtggatcacctgaggtcaggagttcgagaccagcctggccaacatggcgaaaccccatccctactgaaaatacaaaaattagccaggtatggtggtgcacatccgtaatctcaatcactcaggaggctgaggcaggagaattgcttgaacccaggaggcggaggttgcagtgatccgagatggtgccactgcactccaatctgggcaacacagcaagactttgtctcaaaaaaaaaaaaaaatatatatatatatatatatatatgaaaagatcctgagctggggtctgaaaccaggcagcctgccctgctatttgcccagctcctgcatagctcattgtgaggactaaatcatgccaatgcatagaaactacaatacttcacacggtagccagtagccagttactgtcattctgagcacccactgtatgccaggcaccaggctgaaatactttatatacatgttcccgtttaatcatctatgccaccttacaaataacttcctcattttactgctgagaaatctgagtctcagaaaagttgaatgacatgcttcagaccatacagtacatgacaaaatcggtaaatgtgaccgctgccttccaagtctggagaaaaggaggcgaagagaggggaaggcatgaggggaggagagaaggtgggagagggaaaaaggggaagagaagggatgagagtaggagaggcagaaggagtgaggaggagtagcacccctctgcagttattttctttttctttttttttaaatttgagacagagtctcactctgtcacccaggctggagtgcagtgacacaatcacagctcactgcagcctccacctcccgggctcaagtgatccttccacctcagcctcctgagtagctgggatgacaggcgtgcaccaccacacctggctaatctggggaggtttttttttctagagatgggatcttgctatgttgcccaggctggtcttcaactcctgggctcaagcgatcctcctgcttcagcctcccagaattctgggattacaggcgtgagccactgagtgtgaccagggatggtcattttcctctgcacctgtgcttaccctagacaagaaaatgtggaagggaggaaagtttacaggccatgagctggttagagtcaggcccgagtctcactggaatctggactctctcctacatttcttcctttccttgtcgatttcttcttgttgagagcaaaacagtccaaggctgcacaggcttgtctgagagagaaaatatgagaggagaaaattgtggttttgagcaatggctttaaatttttttaatagtgacccacaagagatatcttttattttatttctttatgtatttattttttgtttgtttgttttgtttttttgagacagagtcccactctgttgtccaggctggagtgcagtggcacaatctcagctcactacaacctccacctcctgcgtaaatgattctcctacctcagcctcccaagtagctgggattacaggtgcatgctaccacgcctggctaatttttgtattcttagtagagacaccatattggccaggctggtctgaactcctgacctcaagtgagctgcccgccttggcctaccaaagtgttgggattacacacgcctgtaatttttgtaaaatacaaaaaattagctgggcatggtggtgggtgcctgtagtcccagctacttgggaggctgaggcaggagaatggcatgaacctgggagacagagcttgcagtgagccgagatcacgccactgcactccagcttgggccacagagtgggactctgtctcaaaaaaaaaaaaaaaaaagtgttgggattacagaggtgagccatggcgcccagccgagatatcttttattttgtgactgcagttcatgcacccacacgttgaatggaaaacctttgcacaacacattctgacttactatatgcagtgccctgtggaattttctagaccatttttccaccaaatattgatcatgacccattaagccaatttcactgcccactagtggctaaacaagccaagcgggaaaaatcttggtttggagagcagtgtttctcaatttttctttcattattgttcccctaaggagccctttttacacttttttttctaatcgctgcctatcacgaaagtttaataacacagatatatttatgtctatttacatatatcttttccatattaaaaagagtaagttttttgcccccttgggggcgatattataccagttgagaaggcatcattgtcctaatgctcattttctgagccgcctttatttatttatttacttatttattttattttattttatttttttcagatggagttttactcttttgcacaggctggagtgcagtggcacgatcttgtctcactgcaatctgcccccgctgggttcaagcgattctcctgcctcagtctcccaaggcgcccaccaccacacccagctaatttttgtatttttagtagagacggggtttcaccatgttggccaggctggtctcaaactcctgacctcaagtgatccacccgctttggcctcccaaagtgttgggattacaggcatgagccaccgtgccctgcctctgatccgcctttatacacatcaatcccaacatccaatgagataggattagttccattttgcaagtgattaagtggaagctgagaggttatattaattattgaagattgaaatggctggcaattagactgggaatccagaaacttaccaatatcctaactcagcctctagcttctccaaacctttgtttccccacaaaaaaaaacctcagttatggtcagttatgggtgttttttgttgttgttattgttgttgttgtttttctctatttgacctaataagagcaaacattaggccaggcacagtggctcacacctgtaatcgcaatgctttgggaggccgaggtgggtggatcatgaggtcaggagtttgagaccagcctgaccaacatggtgaaagcccatttctactaaaaatacaaaaaaaattagccaggcgtggtggcacacgcctgtaatcccagctactcaggaagctgaggcaggagaattgcttgaaactgaaaggcagaggctgcagtgagccgagatcagaccactgcactccagcctggtgacagagtaaaactccgtctccaaaagaaaaaaaaagcaaacatttatagagcatttactagacatccggcagcaatctaagccctttatatatattaactaacataatatccacaataatcttaagacagacatactggggtttttgttttgttttgatttttgagacggggtctctcattttgtctcccttgatgaagtacactggtacgattagctcactgtaacctcaaattcctgtgctcaggggatcctcctgcctcagcctcccaagtggctgggactacaggctctcaggctcatcactaccagcttattttttaagtttttcctacagatgggggtctcgatttgttgcccaggttggtctcaaactcctggcctcaagcattctcctaccttggcctcccgaagtgctgggattataggcacaaatcacgtgtcaggtgagacatactctcagtcactgttcggatgaggaaattgaggcacagagaggttgtgtggcttgctcaaggtcatgcaggtagaaagtggcacaagcggggatttgaaccaagtaatctgattttcagagcacaggttgtgcgttttgttttgtttttcaccatgtattattttttgagatggggttctcactctgttgcccaggctggaatgcagtggtgccatctcagcttcctgcaacctccatttgccaggctcaagtgatcctcctgcctcagcctcctgagtagctgggaccataggcaagccaccaccatgcacggctaattttttgtatttttggtagagacagggtttcgccatgttgctcatgctggtctcaaactcctgagctccagcaatacgcccgatcctcctgcctcggcctcacaaagtgctgggattataggtgtgaaccaccatggttagcatgagctaaccatgtccttttttttttttttttaactctgtctcccaagctaaagtgcagtggtgcgatctcagctcactgcaacctccgcctcccaggttcaagcgattctcctgcctcagcctctggagtagctgggattacaagtgtgtgccatcacacttggctaatttttgtatttttagtagagatggggtttcaccatgttgcccaggctggtctcaaactcccgacttcaagtgatctgcctgcctcacacctcccagagtgctgggattacaggcatgagccacagtgctaaactaaccatgtactttattttctttcatttgagatgaagtttcgctcttgttgcccaggctggagggcaatggtgcgatctcggctcactgcaacctccgcctcctgggtttaagctattctcctgcctcagcctcccgagtagctgggattacaggtgcctgccaccacactcggctaattgtttgtattttttttagtagagacagggtttcaacctgttgcccaggctggtctcaaactcctgacctcaggcgatctgcctgccttggcctcccaatgtgctgggattacagaagtaagccactgtggctaccatgtactttaaaaggaaactttttatcactctggaaaatagaaaaccagtaccacctgtgataaacagaaggtaacaaaaaatatacaaaatgaaaacacattttataacattctagctagatactatgggcagctgctcattctgaactggaggctggctctctccttgttcaaaaaagaaagatcaggccgggcgcagtggctcaagcctgtaatcccagcactttggaggccggcgggcggcgggggggtgcggattaactaaggtcaagggttcgagaccagcccctggccaatatggtgtaaccccatctctactaaaaatataaaaattagccgggcgtggtggcatgcacctgtaatcccagctagtcaggaggttgaggcagaagaattgcttgaacccaggaggtggagatttcagtgagccaagatcgtgtcactgtactccagcctgggcgacaaagcaagactccatctcaaaaaaaaaaaaaaaaaaaaaaaaaaagaacaaaaagataagcacagagagaaaggtgttaaagggtttctggcagcaaattgagagtttctcctgcagtaatcagaagcgttgaaagggaattggaaagagaaagagagtagcttgttcagggtgtgtgtgtggtgtgtgtgtgatgtgtgtggtgtgtgtgtggtggggtgtgtgtggggtgggtgtatggggtgtgtgtgtggtgtttgtgtgtgtttgtgtgtgtggtgtgtgtgtgtgtggtttgtgtgtgtggtgtgcgtgggtatggtgtgtgtggtgtgtggtgtgtttgtgtagtgtgtgtggtgtgtgtgtggtgcatgtgtggtgtgtgtgtatttgtgtgtgtggtatgtgtgtttgtgtggtgtgtatggtgtgtgtgtgtggtgtgtgtggtatgtgtggtgtgtgtgtgtggtgtatgtggtgtgtgtgtggtgtatgtggtatgtgtgtggtgagtggtgtgtgtgtttgtgtggtgtgtgtgtgtatttgtgtgtggtatgtgtgtttatgtggtgtgtgtatggtgtgtgtgttgatgtgtttggtgtgtgtttgtgtgtgtgtgtgttgtgtgtgtttgtgtgtgtggtgtgtgtttgtgtgtgtgtgtgtcttcttgctgacataccacctaaaataaacccaagatgggatgcaccacatactctgaacccttgtcgggtggtcaatgggtgttcaggacatcccagcagaggaagggagacacaccagcctgtcctggcctgggtgtgcagccagaaagcatggggccaggctgggcaacacagtgagacctcctctctacaaaaagtcaaaaaaattagctgggcgtggtgctgtgtgcctgtagtcccagctacttaggaggctgaggtgagaggatcgcttgagctagggaggtggaggccacagtgagccatgatcgcgccactgcactccaacctgggtgacagagggagaccctgtctcaaaaacaaaacaaaaacaaacaaaacatagagcattaggcagtccaccacgtgtggaggggcagtgcagggcaggggtataggagggcccatccaagcctctgtgactttggccaccatctttccttcccctagcctgtctccccaggtgagtttcacccccaggcagtccttagagacccgccacccaatttacccttggccttgagtttaccgttctctgttcttccaggttctgccgcccacaggctgtttcactcatcctctccaccgggtgccctgcggaggtgtgcaagtgtgatatcatcaaaggctgtgaataagtaaacaataagtggccagaagtggcctgtttcccacatgatacccagggaagggtccgattccccccgcctgggctctggggcaagtcctggctggcgtgccagagcatttattatttagtatttttacttacctgtcccaggttagggactgtcccaagcaatgccagtcccaccctctatctgcacaccagaaaaagctgagggcacagcaggtgattggagtcagacagctaagggtccaatccctttcttctcacatagactggctgtgtgaccttggccaaatttcacaacctctctgagcctccactgagcacacaccaagtcccattgccaggcctaagtcctgcttctgccagtcactagcctggcatccttgtgcaagggattcaactcctctgagccttgggctcctcatcaatgaaacagcagcacctctacctggggctgctggggtgattaaatgagatctgtgtaaagcacagttgctatacacatacgcattgtgatattcattaatagtcattcaaaatgtatatatttagagatgagatctcgatctgtcgtccaggctggagtgcagtggcatgatcatggctccctgtagccttgaactcctgggctcaactgatcctccctcttcagcctcctaagtagctagaattacaggcatgagccaccatgccctgcctgttgtgtcatctgtctgtctgtctgtctgtctgtctgtctgtctatctatctatctatctatctatctagcgcaatctcggctcattgcaacctctgcccccagcggtcaagcaatcttcccacctcagcctcctgagtagctggggctacaagcatgtgccaccgtgcctggctaatttttgctttttggttttgggtttttttctttttttgagatggagtcttcctctgtcacccaggctggagtccagtggtgcaatctcagctcactgcaacctctgcctcccaggttcaagcaattctcctgcctcagcttcctgagtatctgggattacaggcacgtgccgccatgctcggctaatttttgtatttttagtagagacagggttttaccatgttggccaggctggtcacgaactcctgacctcaagtgatccgcctgcctcggcctcccgcagtgctgggattacaggtgagagccaccacacccagcctaatttttgtattttttgtagagactgggtattcatcatgttggccaggctggtctcaaactcctgacctcaggtgatccacccgcctcagcctcccaaaatgcagggattacaggtgtgagccactgtacgtggcctataattttttttttttttgagatagtgtctcactctgttgcccatgctggagtggagtggtgtaatcatagctcactgtagtctcaaactcctgggctcagccctggcgtggtggctcacgcctgtaatcccagccctttgggaggccaaggcgggtgaattacctgaggtcagaagttcaagaccagcctggtcaacatggtgaaaccctgtctctactaaatatacaaaaattagctgggcgtggtggcgggtgcctgtaatcccagctacttaggagactgaggcagaagaatcgcttgaacccagaaggcagaggttgcagtgagtcaagatcgcacaactgcactccagcctgggcaacaagagtgaaacttcgcctccaaaagaaaaaaaaaaaaccaccaccaacaacaacaaacaaaaaaactcctgggctcaagagattcttccacctcagcttcccaagtagttggaccataaatacacatgaaaattagaaaacatgcatgtctaatttttcttttttttttgtagagatggagttcactatgtttctgaggctggtcttgaactcctgggctcaaccgatcctttcacctcagcttcccaaagtgctgggggattgcaggcatgaaccactgcacctggctatatattttaatgagccttcattctatgccatgtgccttgcatacattttctcaaataatcacagaaagccctgccagtccctgagggttatccccactttccacatgagtacaactgaggctcagtgaggtcaattgacttgtccagggttgcacagatatactgtggcagaactagaattcaaatccagatctttcctggttctaaaggctttttttttttctcgcccaggctggagttcagtgacatgatctcaactcactgcaacctctgccctctgcctccccagttcaagtgattctcctgcctcagcctcccgagtagctgagattacaggcatgcaccaccacgcccagctatttttttttctttttgggggcggagtctctgtctgtcacccaggctggagtgcagtggtgcgatcttggctcactgcaaccttcacctcatgggttccagcaattctcctgtctcagcctcccaagtagcttggattataggcacctgccaccatgcccagctaatttttgtatttttagtagagatggggttttgccatgctagccaagctgatctcaaactcctgacctcaggtggtccgcctgccttggcctcccaaagtgctgggattacaggcgtgagccactgcactggcctaaaggtttttttcgttttgtttccaactgggccattattatttccaacctataagatggaagtaattgtttctgccactcgtgcctcctgtaaggattaagtaagataaagtctgtggagaggcctctgttgacaccagctctagctcagcactgcttctttattcccccagggtaattacctaaacacaagcctttcattttatactaaggaggctggtgaacctcttcttaatctctgggagatgatatcgttggatgtccattggaggcagctgaaagtattagatcagaatcagaactgccaggtcccttcccacgtccaagcctgctgaagcttctttcatcttctgggaactctgcatctctgatctcccacccaccccacgattattggaagtatacaatcctgtctgccctttcctaggggaagtgcggaactacatatgatacatctgacatctccagcttccaacttcgggagaggagactttgcggttagctggctattgtgaagtcagtttttctctgcccccagcaaatgttgtgatgtggatagaagtggggcctcggcacagccaggcgcagtagctcacatctgtaacccagcactttgggaggccgacgtggacaaatcacaaggtcaggagtttaagactagcctggccaacatggtgaaaccctgtctctactaaaaatacaaaaattagccgggcatggtggcatgcgtctgtaatcccagctatttgggaggctgagataggagaatcactcaacttgggaggcagaggttgcagtgcgctgagatcgcaccactgcactctagcgtgggcaacagagcaagactccatctcaaaaaaaaaaaaaaagagaaagaaaagaaatggggccttggcaaagtggggtgcatacatcatcccttgtcttggcttgcctggcaacacacaagcctggggcactgcccgtgctcctgcataatgtatgagcccatggtaggaacaaaacaccagcaccagcgagtctgggcactgcaggccacggacgtgtccaggggccttgccaaggctgaagtctctctgttggcagaatatgcagaatatgtgttcctggaggccttttgtagggctgaggtgagaactggcctcaacttggtcctcaggattccatcagacaataagaccgcccaaggccgggcacagtggttcacgcttgtaatcccagcaattcgagaggctgaggcaggaggatcgcctgagcccaggagttcaaaaacagcctgagcaatacagtgagaccccgtctatacaaaaaattttaaaaattagctgggtgtcgtagcatgcacctgtagtctcagctacttgggagactgaggtggaaggatcccttgagccaggaggtcgaggctgttgtggtgagccatgattgtgccattgcactccagcctgggctaccgagtgagactctgtctcaaaaaaaacaaaaacaaaaacaaaaaccggaagacagcctaagaagacaatcttctttaggatcaataatggtgacattagcaacagctagacttctgttttctgggcttgaaacgccctctgagagggccaggggtggccaagagggtggctgagaccacctcagtatggttgacagtgggagggaagatttggatccagggacacagcccctggcagtttccgtggctgcctcatggtgtaggaaaccccaggagcagcagctgtggtgaggtatgttggggtggagaacatggacaaaaataggtatatggtggcattgtttttaggggaaaatgccaggattcagccatcgtttaggaagtcggaggcctccatagagaggggtgcttgtgtgagcgtgcatgtgtgggtgtgtgcaagtgtctgtgtgtgtgtgatctaaaaaggttaggaatgaaacggggaggtctgagtgccttgaaagccaaggaaattaggacgtgtggaaaacaatgcttcattcgtggatggtgtttggtttcaattcattcatagaatcagtgagtattggctgagtgcagtggctctggcctgtaataccagcaacctgggaggccgaggtgggaggatcatttgaggcaggagttggagactagcctggccaacatagtgagaccccatgtctactttattaaaagaaaaaaacaggccaggcgcagtggctcacacctgtaatcccagcactttgggaggccaaggcgggcagaacacctaaggtcgggagttcgagaccagcctgaccaacatggacaaaccccgtctctactaaaaatacaaaattagctgggcatggtggcacttccagctactctggaagctgaggcaggagaattgcttgaatccagggcggaggttgcagtgagctgagatcacaccattgcactccagcctgggcgacaagagcaaaactccgtttcaaaaaaaaaaaaaaaaaagaaaagaaaagaaaaaagaaagaaagaaagaaaaagaatcagtgagtattcaccaaggctcccagggctaggccaagtactagagctcaggatacggagatgactcagaccaggccccagacacttgcagtctaattgtggagccagacatggaagtgaggaattcaagtatcttgtgagaagtgcgagaacaacagtatctgtaggatgctgtgggaattcacagtccaaagcagccacctctgcctgaggttggcagggagacctcacagaggcaaaactgaggacgtgcttgagggatgaggaagaggtttgaggggaagacagagggtgttccaggcagagggatcagcaactgcaaagctgtggaaatgtgagaccctacacactggttcaggaagcttcagcagatcctactgaaggtggcttatgcctgtaatcccagctacctgggaggctgaggctggaggactgcttgagcccaggagttcaagaccagccttaacaacatagcaagaccacatctctaaaaattcagaaaaaaaggctgggcacagtggctcatgccagtaatcctagcactttgggaggccaaggcgggcgggattgcctgaggttaggagttcgagaccagcctggccaacatggtgaaaccccgtctctactaaaaatacaaaaattaggtgtgcgtggtggcagtcgcctgtaatctcagctactcgggaggctgaggcgggagaatcgcttgaacccaggagacataggttgtagtgagccaagatcacaccattgcactccagcctgggagatgagcgaaaatctgtctccaaaaaataaataaatcaattaataaataaatcagtaaaaaagaaccgggcccggcgcggtggctcacgcctataatcccagcactttgggaagctgaggcgggcgcatcacttgaggtcaggagttcgagaccagcctggtcaacattgcgaaaccctgtctctactaaaaatacaaaaattagccgggtgtggtagtgcgcgcctgtaatcccagctactcgggaggctgaggcaggtgaatcacttgaacacgggaggcggaggttgcagtgagccgagatcgcgccactgcactgcagcctgggcgacagagcgagactccgtctcaaaaataaataaataaataaataaataaataaataaataaatataaataaaatataaaaagtagcattgatgtttacaatatccctgagcggcaggcgtttctcccttttgcagatgctcagtggcttggccggagatacatccaagtggtgggtgtagcctgggggttcaatcctcctgtggcgccccagaacccggtgcctcctccaacgtccggcatctgatgaggatccgacccaggcgggcggcggcgggattcgctcttccccttcgctccccgcgagaaagccccgagggccgcggcggcgcagagccggtgacagttgaagcttaggcgggaagagggaggcgcgaggcgggaagagggagtttgggcctcggcagccgccgtacaaacaccgctctggtcaccatggcaacagcgggatgccgcgaacggcttctgggcggggccggtccctcggacgattggacctagcttggcgcggaatccgtgaattgcccgcggcccgagggtgcaggtgatgggtgctgaccgactggggaagcccggagtgtggggactgaggaggggagtggcctggggcgcgctggagcctgcgaggaaggcgccgcctcggatcccccgccccccattccccttcccgaattccaccctccggcccagccatggcctcagtttccccaaacaggaaagggaaggagggtgggcaccccggtctaacggtgcctctcagcctctgagacccagaaccttccttctgcagctcccggactgactggctctgcccttccccatggacgtaagtccgggccccttcccctctctgggccccctcagcgccctctcctaaccccgaatgggcctgtcttccagcacggactggggagggggcttctacccaacagagactacaacctgccagctcaggacgagagctgtcaggaagagtccaggaatggacttcccacgggagggcacatttctggtattcctggcaagataaggagttgactaagtaatccacgagaaaaggcatttccggcagaggaaacagtctgggggtgagagggaggctgcagcatttggggaactgctagggctatcgtgtgtttggaagagggggagggagagaggtaggcagggctaaattgggaattttgtcactgacataaattttaagtgccaggcgtggtggctgtcgcctgtaattccagctactgaggagactgaggtgggaggatcgtttaagcccaggagctcgaggctgcagcgagccatgatcatgccgctgcactccagcctgggtgacagagtgagacactgtctctaaaaaaattgaccaggtgcggtggctcatgcctggaatcccagcactttgggaggccgaggcgggcggatcacctgagatcaggagttcaagaccagcctggccaacatggcaaaaccccctctgtactaaaaatacaaacattagctgggcgtcgtggcgcgcacctgtaatcccagctactagggaggctgaagtaggagaatcgcttgaacccgggtggcagaggttgcatgaaccaagcttgccccactgctccagcctgggtgacagtgatactccgtctcaataagaataataataataaaataaataatagaaaaagttttaagtgagttactgggagccattgacggattgtaagggagggagggatactacacaaggacatctggtgtggaaaggggcaaaattgcaggttggatgacaggagccggtaatgtgggctgagggatggtaaaggagtggcaagggagtcagagacaagagatctctttggagaggcattccagaaggaaaatcagccctagaagactctagaatgctgaagtgcttgatgttgctgaactgggaatgatagggaaaaaggcaggctcagggcacaagataatgagtcagggtgtagtcctgttgacgctctccccaccatctggtggccgttcctctcccagccacctcctcgtccctcatggtattcccgtgttcctgcagcccctctccatctccttgtcaccccttcctcctgtactcgtccaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggtgaggggtctggtcggggataaagggtgggctctggggaagaggaatcccggtaacctgtcccttcatctgcaggctcttaccctgagacacttgacatttagcccttgcatctatccgttttgtggtaccagggggtccctcctctcctgtccccagccaaaccttttcctttcccctcgggaaagctgccttggctgtcactacctgctgcctattccacatcctgaaccctgtgacctaggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgtgagttccattcctaccccctgccccactgagccctgatctaggtatgatcggtgcattcatttttttgctcaacaacatttattactgagcaccttctcaaggccaggcacggttccagggcatgaatcatgtgcagccaggtaaaaacaacctatcagataatgcctggtgatgaaagctacttgaagaaaataaaatagggtgccagctggagaaaggtgatgtgggtaacatgtagagtacatagccagcacttctaaatgaaagtgagctaaatgaaagttagctaaatgaaaaaacagctcacacagctcctttccgttcaccgaatgaactgtgttctaggtatagggcctctttacggacctttgtttttcccaacaaccctgagaactgagaactaagttgtttttttttctttcctccctccagagctgggtcctcccgtctcctcccctcccctcttcttttctttttgttgttgtttgagacagggtttcactctctcgcccaggctggagtgcagtggtgcgatctaggctcactgcaacctccacctcccaggctcaagtgattctcctgcctcagcctcctgaatagctgggattataggctcacacaactaccatatggctaatttttatatttttagtaaagacggggtttcatcatgttggccaggctggtctcgaactcctgacctcaaatgatccacccgccttggctgcccaacgtgctgggattacaggcgtgagccaccatggcccagccatggttttttttttttttttttttttgagacggagtctcgctctgttgcctaggctagagtacagtggtgtaatctcagctcactgcaatgtccacctcctgggttcaagcaattctcctgcctcagcctcctgagtagtaggaatacaggcgtgtgccaccacgcccagctaatttttgtatttttagtagagacggggtttcaccatgttggccaggctggtctcgaactcctgacctcaggtgatccagagctgggtattttttaaaacctatatgttttttctgattacaaaaagtattatttacaaagtatacatatagaaatacatggaaagtaccaatcactttacaaacccgctctctatcccaaagttgctgtgttttacatgtatctctcatatactaatacagtactatcactgctgtattttaccattatttggcaaaaatggggtggtatcatgtaggttatttcatcatacctgctactgtccccctatcccccgccttttttgagacacgatcttgctctgtcacccaggctggagtctggtggtgcaatcatagctcactgcagcctctacctcctggactgaagcaatcctcccacctcagcctcctgagtagctgagactataggtgcatgccaccacacccagctaatgtttatatctttcacacagatggggtttcatgttgttgcccaggctggtgttgaactcctgggctcaagcgatctgccatcctcagcctcccaaagtgctgggattacaggagtgagccaccatgcccagcctctacttgccctttttttttttttttttgagacgagtcttgctcttgtcacccaggctggagtgcaatggtgcaatctcggctcaccgcaatctctgcctactgggttcaagctattctcctgcctcagcctcccaagtagctgggattacagggatgcgccaccacactaggctaattttgtatttttagtagagacagggtttctccatgttggtcagggtggtctcgaactcccgacctcaggttatctgcctgcctcggcctcctaaagtgctggaattacagatgtgagccaccgggctcagcctctacttgccctttttaacctgacatcacacttcgccacctatccatgcctgtatgtgtagacacataagggttactgtcctcctcctgaagtggggagtaagctggcttagggaagtttagtggcttctccagagtgttacgcaggagagccttgcatcgcaaatagctccacagcgttagctgaggtagaatcctcaggggagaagcctggcttggagaagacaacctgtttctatttgtgggtttaaagatgttaaatgtaatcgaccaccgtcctgaggaatgattattttgagctcagcgattcagacagcaaagcccctgcccttggagtggtgacattccttccctaggatggaaggggaggataaaagcaaattcataacttgggcatatggtgattggtgctaatccctggcatgttttcagttttgaagtaaattgtggggcaaggagcgctttttcagataatcaccttctggtttgccaggggcagtcagcagaggggtctcaggtttggggctgaggggcagaagggcaaaaggaggagaccttgggttctgaaaactcctgtcttggcgtggtggcactcgcctgtaatcccagctactggaaaggctgaggcaggagaatagcttgaacccagtaggcagagattgcggtgagctgagatcatgccactgcactccagcctgggtgacagagtgagactctgtctcaaaaaaaaaaaaccaaagcaaaaaaacctcttgccttagaggagatgctccattagaaaatgatttctggccccctgtcctggggatgccgccccctaccccttctgtctatttgaagtgaatagccagggactcatcacctccttgggagagaggatgggtgaggtgcattgtaaggatagactgggccttcccaccttccccacagagggctgcaagaactttcaaacctggagacatcaggccctgatcctctctggtttctgctggagctaggaagggatttaacagggtggaggacagggcaggttctttctgtccttgagctgtctttccacaaagtatatttaagtccctccctcttcagtttccttgtaataacagcccagaaggttacaaatgtcttgccacttggcagctgtagacactgaggcttacggaggttggagtgacttggaggttatatggctggatcagctggaatagaaacccaggtttctcttccttactgagggagaaacatgcctgctcgcctgctctgcttcttttttttttcttttttcttttttttttgagacggagtcttgttctgtcacccatgctggagtgcagtggtgcaatcttggctcacttcaacctccgcctctcgggttcaagcgattctcctgcctcagcctcctgagtagctgggattacaggtgcccgccaccacacctggctaattttttgtatttttagtagagatggggtttcgtgttagccaggatggtcttgatctcctgacctcgtgatccgcccgccttggcctcccaaagtgctgggattacaggcgtgagccaccacgcctggcctgctctgcttctttcatgtgcatgttgcaaggttctcattcattcattcattcattcattgactcactcaccaaagatttatggagttactgttgaggcactgtctagggccttggggactcagcagaaacaagatggagaaggtccccagcctcgcagggcttccattctggtgatggagagagagaaataaccaggccattacaacagagggtgagaaatgacgtgctatggagcagcggttgctcagccctgcatgcgatcagaagcaggtataggacttaaaaggaaagccaggcatctaggccccacactgaggtctgggctggggctagagtttgtgaatcttttacaagttctcatatgattctgatgcacacaggttaagaaccactgctgagggaagaagctatgataagaatagctctctttcaggccgggtgcggtggctcatgcctgtaatcccagcactttgggaggccaaggcgggcagatcacaaggtcaggagttcgagaccatcctggctaacacggtaaaaccccgtctctactaaaatacaaaaaaaattagccgggcgtggtggcgggcgcctgtagtcccagctactcgggaggctgaggcaggagaatgctgtaaaacccgggaggcggaccttgcagtgagccgagatcgtgccactgcactccagcctgggagacagagcaagattccgtctcaaaaaataataataataataataatatctctctttcttttttttttttttcccaggcagggtctctcttgtcacccaggctggagtgcagtgctccctctgttgcccaggctggaatgcggtggcgtaatctcggctcactgcaacctccgtcccccaggttcgagtgattctcctgcctcagactcccaagtagctgagattacaggcacctgccaccatgcccggctaaagtttgtatttttagtagagacaggttttcaccatgttggccaggctggtcttgaattcctgacctcaggtgatccacctgccttggcctcccaaagtgctgcgattacatacaggcgtgagtcgccatgcccggccaagaacagctctctttcgtccagcactcattacttaccaggcatcgtgcttagttccttccaccgattcccgacaatggccttatgaactaggtcttatattttttcattttattttattttattcttttgagatggagtctcactctgttgcccaggctagagtgcagtaaaacaatctcggctcactgcaatctccatctcctgggtttaagcaagtctcccacctcagcctcccaagtagctgggaccacaggcgtgcgccaccatgcccagctaattttcgtatttttaatagagatgatgtttcaccatgttggccaggctagtcttgaactcctgatctcagatggtgcgcccaccttggcctcccaaagtgctgggattacaggtgtgagccaccacacctggccttaggtgttatattcctataaatgaggaaactgaggctgaaaaaatgaattagccaagctgaggttcaaacccaggccttactgactctagggcctgagctttaaccatctatacgatgatggctggctctcacagagacaacaggaaaaattcaagtgaaaaactctcctgagagccaggagagacacaagggttaacagtcttgcggagtccttgtttaatgtacttaaacagcagattccttccagaagccacatggctgcttgtaacggttgagaaatccattagccagttattaatgacaagatctaaacccttccaagggagagagccaagaaatgcttttaataccctcttttctgaggtaatggcagcagagcctctctcagccatgggttctgtgcacagaatgatggtgtggtccttcaaaagcccgcagaagtgatttcatccccagactgagactccctagagacaccccaaatcacaccctcatcaaacacaagaaaatcacttctctctcccccttccaccatgacggttctagcctcccccaaggaggcagttctgttgacagtagcacagcccaattcagacccctgtccctgcaggtggcaggtcccctcccctcactgcagcccctagtgatatctgatctcaccagccatctgacaccacaccctgaaacctcagctgttggaaaggtcattcccctattcctggcttggccaagtttctgattgaactgtacaactgtgactgtcactacctctgcctctggcctcaaggagccaatcttctgtcacacagccatcctgggccacttcagccatttggcctgactccagcccatgcctaaggcagttgcgggtcatccctgtcccaggggaggacagcagtgcactggatagaccagttctcccttcttgtctctaaggacacgctgctcctattccccaaagagacagacattgtttcctccaggagctgagaagccctcttctttcttctttgcctaaagaaggcaaatgatatgcttagattcatccattcattcagcattcatttatatctcagacacctgctgagcatgagtccagtgctagctcagtggagaatatgggatgagctgcccctgccctggcagacccagagagaggctgatgctcctggcactgggaggcagagggctcaagagggattgcaggcaggactgtacatcccagctccattcccatcacttgcctctctgtctatgcctccatttcctttttttttttttttttttttttttttttgaggcagagtcttgttctgttgcccaggctggagtgcagtgggtcgatctcggcttactgcaacctctgcctcccaggctcaagcgattctcctgcttcaggcttctgagtagctaggattacaggtgcaccccaccacgcccagctaatttttgtgtttttagtagagaagaggtttcgccatgttggcccagctggtcctgaattcctgaccttaagtgatccgcccaccttggcctcccaagttgttgggattacaggcatgagccaccatgtctaaccatccattttctcttttgtaaagaagcccattactcaggattctggtaattaaaaaatataaggctgggcgcggtggctcacacctgtaatcccagcactttgggaggccgaggtgggcggatcacctgaggtcaggagttcgagaccagcctgactaacatggtgaaaccctgtctctactaaaaatacaaaaattagctgggtgtagtggcgggcgcctgtaatcccagctactcaggaggctgagacaggagaatcacttgaacccgggaggcagaggttgccccaagctgagatcccaccattgcactccagcctgggtgacagagcaagactccgtttgaaaaaacaaacaaacaaatagatctaattcttttgaaaacattaaaattgattgggcgcagtggcgcatgcctgtaatcccagcactttgggagaccaaggtgggtttagcccaggagtttgagactagcctgggcaacatgatgaaaccctgtctctacaaaaaaatacaaaaaatgaattagccaggcgtggtggcacgtgcctgtaatcccagctacttgggaggctgaggcaggagaatcgcttgaacccaggaggcggaggttgcagtgagccgagaccgcgccatggcactccagcctggcaacagagcgagactccgtctcaaaaaaaaaaaaaaaaaagtacaaaaaatgagccgagcacggtggttcatgcctgtaatcccagcactttgggaggccaaggcgggcagatacctgaggtcaggaattcaagaccagcctggtcaacatagcgaaaccctgtctctactaaaaatacaaaattagccaagtgtggtggcacatgcctgtaatcccacctacttgggaggctgaggcaggagaaccgcttgaatccagaggtggaagttgcagtgagtggagatcacgccattgtgctccagcctgggcaacaggagtgaaactccatctcggaaaaaaaaaaaaaaaaatggccgggcacagttgctcactcctttaatcttagcactttgggaggctgaggcaggtggatcatctgaggccaggagttccgagaccagcctgaccaacatggtgaaacccccatctctactacaaatacaaaaattagctgggtgtggtggctcacgcctgtagttcagctactcagaaggctgaggcagaactacttgaacccaggaggtggaggttgcagtgagccaagatcgcaccattgcactccaccctgggcaacagagtgagaccctgtctcaaaaaaaaaaaaaaaattaaaaataggtaaattgccattttcaaagatacctgtaaagatttttaaaatcattcatgaatgcggtctgttcgttgcacagagtagatgctcaaaaatggtgaatgagaccctctattttggtctcatgctgaagaagtccataaagcccacaagtcattttcatgatggacagaaaaatgtgtgtgctttctctgtctactgcctcaactgcacagaccccgggactgtagcagaaccatcttttgagcttgacaccgggaggcccaaattctagcacgggacccagggccagttgctctctggtcctcagtctcctcacccataaaatgggaaggagagaaccctgaatcattgcttctagcttctgaactcagttgttcagaacaaggactcactgctgatttttcaacagcacagggaattgcactgttcctgggaatgatggacagtaccctctgttccactgggcaagtgagatttcccaggcctctctgttcccttctccccttagagagcaacagacgtggccccatcccacctccctcaaccctctctctcctccctcaggactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtgagtgtagtgccagtatctactctccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggtgagtgggcaggggctccctccccatcaatagggccgacccaagtcttcctcccccttcccccatgccgggccccacgatagtgtgaatgtcaggggcttcaggtttccctaaatataggtccctgccagaggatccgtggcgggaaaagggcaggggtcattagagaagatcggggacacatgtggggcgggcaggagctgccttataaccagcccgggaacccctagctcactcgctgctgaccaggctctgccggctccttcggcctcgccgcaggtgggccccttgcaggaccgggccggggtggggatggggttggggttgggccaacagggtccagatggggtccaggtgaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggtagcagagcccagaagaagaaagagcccctgttctctgttttttctgggcagaaaaggagtgaaaggtggaaggaccttcctgctctgttttatacttggccagggcttcaagaaaggctgagagcttgtgacattttcttccagccactgcaggctctgccccttcacctaacagcataagatagggctaacagttggggagtatggttgtaactgctcatgtcttaggaggcttcagcctcagcacttttaggtccagaactcaaggggggcagaagacccctgtgacaaaaacccactaactagctcatgagtgacatgagccaggcaacataatgggtgttttatatgagtagatgctgttatttttaatttatacctaaggctcttttgcccaagattgaactgtttcttggtggaaaggattatcaatgcatatctcttttttttttttttttgagacaatctcactctgtcacccagactggagtacagtggcacgatcttggctcactgcaacctctgcctcctgggctcaagcgattgtcctgcctcagcctcccaagtagctgggattacaggctcacgccactatcgcctggctaatctttgtgttttttagtagaggtggagtttcatcacattggccaggctagtctccaactcctgacctcacatggttcctccacctcagcctcccatagtgctgagatgataggcgtgagccactgcgcccagccaatgcttatctccttaatctacactattgagttttctgttttcccatctttttttttttttctttttgagacagtttcgctcttgttgcccaggatggagtgcaatggcacggtctctgctcactgcaacctccccctcccgggttcaagtgattctcctgcctcagcctccacagtagctgggattacaggcgcaagccaccacacccggctaattttttatttttagtagagacgaggtttcgccatgttggccaggctggtctcgaactcctgacctcaggtaatccgcctgcctcagcctcccaaagtgctgggatgataggcgtgactgcgcctggcctgttttcccattttaacaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatctctgcagtgattcaggtagaacggagttacctagaaccttctaggagtataaaaacttggtcctaggccgggtgcggtggctgacgcctataatcccatcattttgggagaccaaggtgggcggatcatgaggtcaggagtttgagaccagcctggacaacatagtgaaaccttgtgtctactaaaaatacaaaaattagccgggcatagtggcgcacacctgtagtttcaactacttgggaggcggaggcaggagaattgcttgaacccaggaggcagaggtaatggtgagccgagattgtgccactgcactccagcctaggcaacagagccagactccgtcccaaaaaataaaaataaaacttggtccttcccttttctgcttattttgcttttattgcttacatctaaaacaaaaccaatcactattatccctctaaactttggattaatttgtctgcctagctcattcaactctgggaaacaaacactgaagtaaagcaaataaaaattgaaggtcggtagaagatggcaaagggggcattccaaaagggaacatgtgcagagtctcagagactggagagattgtttaaagatcaatagtttcagccgggcacggtggctcacaactgtaatcctagcactttgggaggctaagtccggcggatcacgaggtcaggagttcaagaccagcctagccaatgtggtgaaacccccgtctccactaataatacaaaaattagctgggcatggtggcgcgcgcctgtagtcccagctactcgggagactgaggcaagaagagtcgcttgaatctaggaggtggaggttgcgctgagccaagattgtgccaccacactccatcctgggcaacagagcgagactccgtctcaaaaaaaaaaaaataaaaaagactagagaagcagagaacgtcatataccagtttgggggatttggacttttatttatttatttattttgagacgaagtctcgctctgtagcccaggccggagggcagtggcacgatctgggctcactgcaacctctgcctcccgggttcaaaccgattatcctgcctcagcctctccagagtagctgggattacaggtgcacgctactgcacccggctaattttttgtatttttagtagagacggggtttcaccatgttggccaggctggtcttgaacccccaatctcaggtaatccgcctgccttggcctcccaaagtgctaagattacaggcgtgagccaccatgcctggcctggacctcttaattttatgataatctgagttcccgaaagagtaattgatagaaaaaaaaactacacctgaggacacaactttctgagttcaaatttctttttttttgagacagcatttcactctgttgtccaagctggagtgcggtgtcacaatttcggctcactgcaacccccgcctcctgggttcaagcgattctcctgcctcagcctcccaggtagctgggactacaagcgcatcaccaaacctaattattattattttttattttttaggatagacagggtttcaccatgttggtcaggctgatcttgaattcctgacctcaggtgatccacctgcctcggctgcccaaagtgctgggattacaggtgtgagccaccacacacagccaggttcaaatttctttcttttttttttttgagacagagtctcgctctgttgcccaggctggagtccagtgacgcaatcttggctcgctgcacgctctgcctcctgggttcacgccattctcctgcctcagcctcccaagtagctgggactacaggcgcccgccaccacgcccagctatttttttgtatttttagtagagacggggtttcactatgttagccaggatggtctcgatctcctgatctcgtgatccgcccgcctcagcctcccaaagtgctgggattacaggcgtcagccaccgcgcccagcccaagtttcttattctttttgtttatagactgggtctcactctgttgcccagcctggtcttgaactcctgggcttaagtgattcgcctcggcctcccaaagtgctgggattacatgcttgagccaccacacctagccccggattcaaatttcagtgtaacatccccaatccactgttatacaagcaatgaacaagttatttaacccctctgagccagtttcctcctcttaaaaaaggcacaaaacttaatagaaagcaactaagaagccaggcacggtggctcaagctggtaatcccagcactttccgaggccgaggagagtggatcacctgaggtcaggagttcgagaccagcctgaccaaaatggtgaaaccccgtctctattaaaaatgcaaaaattagctgggcgtggtgacgggtgcttgtaatcccagctactcaggtggctgaggcaggagaattgcttgaacccaggaggcggaggttgcggtttgccaaaatcgctccactgcactcccgcctgggcgacaagagcaaggaaggctctgtcttaaaaaaataaataaatgaaaatacaaaaattagccaggcgtcgtggcacatgcctgtaatcccagctacttgggaggctgaggcaggagaatcgcttgaacctgggaggcggaggttgcagtgagccgagattgtgccactgcactccagtcggggtgaaaaagcaagactccgtctcaaaaaaaaaaaaaaaaaaaaaaaaagaggccgggcacggtggtacacgcctgtggtacagcactttgggaggctgaggcaggtggatcatgaggtcaggagatcgagaccatcctggctaacacggtgaaaccccgtctccactaaaaaatacaaaaaaattagccgggcctggtggcgggcgcctgtagtcccagctattcaggaggcagaggcaagagaatggcgtgaacccgggaggcggagcttgcagtgagccgagatggcgccactggactgcagcctgggcgacagagcgagagagtgagactctgtctcaaaaagaaaaacggaagcaactaagaaatgtcaagagtgccattttggaatcagagaagtcatgctgactgaggcacaggcttggcgtgggaaaagtggactccaatctgttaacttctgaagttgtccacggcaaatatttctctgacggcacaggaagagatctgaacttggcttccctcatccattgaacaagtattaacaagtatctatatatgcctaccgtgccaggccttattctaaccactggggctgcaatatttaaaaagacaaagttggatcctccaaggactgtggtggggaaggctgacaaaacaagtaacaaaaatgtgtaacattaaaaaaaaagtgtaatgttaaaaaaaaaaagtgtaataaagttacaaagcctagccccagctcggcttgtttccctagctgaaatgggggatggccgggcgcggtggctcacgcctgtaatcccagcactttgggaggcccgaggcgggaagatagcttgtgcccaggagttcgaggtcacagtgacctatgatagccccaccgactccagcctgagcgatagagcgagaccctgtctctaatttagaaaaaagaaagttgtggccgggcgcggtggctcacgcctgtaatcccagcactttgggaggccgaagggtggtggtgggtgggggcgcggatcacctgaggtagggagttagagaccagcctgaccaacatggagaaaccccgtctctattaaaaatacaaaattagcccagcgtggtagcgcatgcctgtaatcccagctactcaggaggctgaggcaggagaattgctggaacccgggaggcggaagttgcggtgagccgagttcgtgccattgcaccccggcctgggcaacagcaaaactccgtctcaaaaaaagaaaagacagttgtttaaacatttttatgaaatgatatgggaggggactggtctagggtttctaatagcctccacatcgcccagcggcagagcccacaaaactgccactggccgccaccgggttcctccacctccttcccgatctcaggctggagaagtggtgcaggggtcgctgcgaaaggagaggagcgtgtatgacgccacatccggcgcgcggcggaactggcctcctttgcttccgcggcggggccggaagtaggagcggcggcggcggcggcggcggcggtcgaaagcggagtgaaagagggaggcagggagccggagagccggaaccggagtcgcagcggcggtaatagtgcgagactcctctaagtcaccgtccttagcgcgggaccgcggggttcgacgggagttagcgggggtgcggccaggccgttggacgccggggggtcctggggccgatgtgaggggaggcgggggtgggggagccgggccggctctagaatcgagttgtccgctccgagccccggacggacactgatccgcgggctcgtcttggcctttcccaggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtgagctcgttggccctggggaagggaggccaagccgccgcccacgggttctggcctggggcaaacccaactgagaactttgggcttgcctcgttctggaagctttcccagagaggagcaggatggagccgctgccctcgaggaaaagctagcctgctcggggaagacagagtggataaagacacttaaagtttattagacgatgtgtttccagtggagtaagagtgttacataaagtacttaggaaactcaaggaaacaagtccatctgtcgggggacggaagcttgttggaggggggccgaactgtgggagaggcctcgaataaggaggtggtaaaagagtcagccaaaaaccaaaagtttaagacaggaaagttaaagaccctgtgatttataaaagtcttctaattacaacaacccttaaagattggtggtattgtactcattttacaggtgggaactttcatgttcaaagttacccacaagtaaggaatggggtctgaagccagctcttagtgtcctgtcctttttcaggccataatgcaaaaaggtggagttggatcattcacgttcagggtgggagcctgagaaatcgtagcaagtaagccagggtagaattaagcacgatagggaggccagttcagagttctgtgggaagtaggatgatgtagtggttaaggctctaggttttgcagtgtgagatggctctaggtttgaatctgaactctgccgctttctagctgtgttagtaatcttaagtgtctttatttgtaaagcagaattaatagtacttaataagatgattgtgaagattcagtgagttggtgctggagatgaggttagcacagtgttttggtacagcatacgtgcttgataatcaccaggtattctatttcttttggaagagggcaataatgagatgggctaaagccatcagggagggcttttgagtggaggtaggccttgaaggatgaagataatttggctagctgatggaggcagggccagtgagggaagggcattccaagcaggacgaatgtaacagtggaggccctgagatgcgtggggaacagtcaggggtttaattacctgcctcctctggggaactgtgtgattgtggcttctaccaggctggagaattgtggcagaagagcccacagaattaccctacgtttattgaacagtaaacattggcctttacagggccactatttggcctggcccggtactggcaaaaaacttctatccatctcttccccccagcaatcctatgaggttggaatcatttgctgcattttatcgaataggaagccatgactcgtagaggtctggtgacttaactgaggtcacccactgaggacgtggcagagctgggtcctgaatctgtggccctcaggctctttgcctggccctgcctcacatagactacctgcagccagacagggcctgtgaggggatgatgagcagggtcggcctctttttcgccacctgtctgtggcttttctcttttgccagctgaccagaccagccccatggtgtttttagttgtcccctttccctcagtcctgattggcatttttaggaacttaaacctgttgttgcctggcactattctttaacctcgaagtattgtctccctcacgggccctggatcagtgtggtggtgatggtagacaaagcttagatagcatgctggagtttgcagaatagcaggaagtcgtatattcagtctccatggctccttgcaacagcctaaggaatacgcagggtgggctgagtacttagccccatttcatagcagaggaaactgagcctttgagtagataatgtcttgcccaacatcacgcagctagtcggaggggaagttagttttgcatccaggtctttgactgtgctccgtggtcactgagagccaggcagaggcatttagattttgatgtggggtgtgaggcagcaggaagccatggaaggctgaggggtggagggtcctgcccagttgaaactgagtggaactaggaggtactaggccaaggcctgagttggccgctgttgtcccaggctcagtctgaagcagggccatctctgatacctggttatggcctcctggggacccatcagagacccaggctgaggctggtggtgtcaagagcaccagcttgcctagagggcacagacatgcagatgaaaccagtggaagcacagaggtccgcagtgtctgagctgaaattgctgctactagaaatattagcacagtaggagagctgagcttttgaatcaggtggtcttcagtatgaatctttgccttgtcacctagaagcaatatgaccctcgtcaagtcactttctgattttttgaagtgataatgacatgcagttgagagtccgggtatccgggcacagggcctgctgcgctggtagccgttactgcaggcaggtcctgatagggctggggaagtgctgcaagtggcagaactggggctggaatctgggcctgattcccaggccacactggggttgcgctggcactgaggggggctttgcagagagcacgggccctgcatgtgacctccctgggcttcaggttttcactcagggtctgtggaaggggctggcataaattctcaggaaattgggcttctgggttccaatttagccactctccagcttggtgaccttgaccctcccgcttttctgtaagctttggtttctttttttctttttttttttttttgagacagagttttgctgttgttgcccaggctggagtgccagtggcctgatcttggctcactgcaacctccacctcctaggttcaagtgattctcctacctcagcctcccaagtagctgggattacaggcacgcgccaccatgcccagctaatttttgtatatttactagagacggggtttcaccatgttggccaggatggtctcaatctcttgacctcatgatctgcctgccttggcttcccaaagtgctgggattacaggcatgagccaccgcgcccggcctagcttcggtttctttactgttacgtgaggctgaagagaacctccccagtctgttggaaaggtcactatgagcagttgatggggaaggatgttcagcacaagaagcagtgcaggtgggagagtccgggtactgatgtggcctcttggaccaccgccagtgctgccttctgttcccagaaagccagggcagacctccttcgtgctgcctctgccatacagagcaaggggcataagtgaatcctcctgtccactgagctcaggaaactcattctaagggaagagattggcagaaagaggggggccaggcgagttgggcctcccacatcagaatatcttgataaagagtcagaccccagagccaggcttccctggttcatatcccacctgtgtcactggcaccaagccagcctccttccctgcttcaatttcttcatctgtgtaccgggaatcatcatagtacctgcctgccaagctcttaataacatttgtggcacacagtatgagctcgaatgttcactgctgctattaccaggcaaaatttggaaatacagtgttgcttaaattgggtatctataggctgggtgcagtggctcacatctgtaatcccagcactttgggaggcaaaggtgggtagatcacttgaggtcaggagttcgagaccagcctgggcaacatagtgaaatctcgactctactaaaaatacaaaaattagctgggcgtggtggtacatgcttctaatcccagctactcgggaggttgaggcaggagaatcacttgacccaggaagcagaggtttgcagtgagcaaagatggcgccactgcactccagactgggcaatggagccagactctgtctcaaaaaaaaaaaaaaaaaaaaaaaattgggtgtcttacctggcaaagtgatttcatctcctgctcactcaagtagaagtagactgcactgcaaggagaaataaaaaatatttaagtcctcatagtcataaagaaatactgaacacatggcaagagcacctcacttttttttttttttttttgagatgaagtcttgctctgtcgcccaggctggagtgcagtggcgcgatcttagctcactgcagcccccacctcccaggttcaagcgattctcctgcctcagcctcccaagtagctgggattacaggcacgcgccaccacgcctggctaatttttgtatatttagtagagacagggtttcaccatgttagtcaggctggtctcaaactcctgacctcgtgatctgcccaccctggcatcccaaagtgctgggattacaggcatgagccaccgcacctggccaagagcgcatcactttgaaggcgcatccactgtgggcctgccctgggcacctacccttgtgtctggatagcctgggagaagggctctgtgattggccaagggtgacttaagctctgctgtggagaggatggggagacccgcctcccaggagtgagtcctggatgcggaagagggagcggcagggggagtcagggctggaaaagtcccagcctgctcagaaggcctggaacgctgggataagaggttggactttgtccttttggcagcagggggccacggaagggtgttgcatgctgaagggccgtggtcagcctgttttggggagactgtacgcttcactcctgccccctggagcttccaggactgcctcatatcctcccctccccccaaaaaaggtcaggaattgggctgggctggcctggctgtggtgaccctggtcttctcctgtctccagagagatcttggtagaggagagcaacgtgcagagggtggactcgccagtcacagtgagtacctgctgtccctgcagagccaggcctggtctttcaggcacatgaagtttcctcttcatcttgggggctctataagcccaaccctaagctcttttatctgtcctttccctcaccttcaacggagcactgctaaaagaagtgggggttgctgtgcacgttggctcacacctgtgatcccagcattttgggagggcaaggtgggcacatcacttgaggttaggagttcgagaccagcctggccaacatggtgaaaccgtttctactaaaaatacaaaaattagccacgcgtggtggcacgtgcctgtaatcccagctacttgggaggctgaggcaggagaatcgcttgaaccccagagttggagattgcagtgagctgagatcaggccactgcactccagcctgggtgacagagggagactccgtctcaaaaaaaaacaaaaaaaaacaaaaaaaacaggccgggcgcggcggctcacgcctgtaatcccagcactttgggaggccgaggcaggtggatcatgaggtcaggagatcgagaccatcctggctaacatggtgaaaccccatctctactaaaaatacaaaaaaattagccaggtgtggtggtggacacctgtagtcccagctactcgggaggctgaggcaggagaatgacgtgaacccaggaggcggagcttgcagtgagccgagatcgcgccaccgcactccaggctaggcgacagagtgagactccgtctaaaaaaaaaaaaaagaaaggaaagaaaagaaaggggttatgggaagggactttggatttgttagtggagattcttggccagggcagaaggactcctatttggcgagtgattctgctcacatatctccagggctctgtgttagtaacttgattctgggtactttgtggggagtagagagaggaaggggccgggacatctacctggaaggacttagttctagctcttgcctacagaatagttggtactcagcataggacagtgggtatggttccagaccagactgacttggggtgggagaggagaattttggtcctaggaagtagaagtgcagccaagagtgataaagctcactaaagcagcgggtgtttggagggtagtccctggcaactcccactgcttgagttccaaccccactcttcctgttccccaggtgtgcggcgacatccatggacaattctatgacctcaaagagctgttcagagtaagagtgtggccaacactgtgaaatgtaacggggggatgactggaagacccctgtaattgagggtgggagccttaatttggggcgtggagtgggggcaaggggccccaagttagatgggtggttgtggaagaagggcctccgctggacagaaacaggtagggggtaggggactgtttacgacagggcaaaactttctacttccccacaggtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccacccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaaggtaagccagcccagggctccatgggacagggagaggaggggggcttcaggcctcagccccgtcctctttccctgctctcccctgtagatcttctgcgtgcacgggggcctctccccctccatccagaccctggatcagattcggacaatcgaccgaaagcaagaggtgcctcatgatgggcccatgtgtgacctcctctggtctgacccagaaggtgagggcatgtgggcaggggcaggcagggacagccaggaggggttgggaaagagagggagcagggctggtcttcactgtcactcgtcctccacctgccaaatggctggaaccctggaggaggagcagggaggcctgcatggcaggtgctttgagcacacagtggcttggggcatggcccagagggctgtggaggacaaccaagtcatggctccctgaagtgaaggggccttagaacatgacagcagcttcttcagaggtcagaaccccagaatggtagccccctgagacccctcattttgtgggttttccactagtgtagagcagagctgagatttaaagtcaggtcttctgaggaccagccagagttcctgttgtcacaggcacacacgcacaggcagcctctgctccagcgcagacacacacacacatacacatagcctctgctccatcacagccacacacacgcacacgaggcctctgctccatcacagccacacacatacagacacacacatgcagacacacacatgcagccgctgctccacagtcactccggacctccctgtgacaacacagggtgcccttctgtctctgggagtgcccctttcactcttatgtgctgtttggacggggattgtatgatcactgtgattatgagggggccccaggcattgggcgttctttctcctctggagcttatctgcccctacatttgctgtcctggtccccgccatcccacagaccatattcaggccccatgctctggtcccacgggcctctggtggacttggggaggggccaggctgctcaccctcaaggggcagcgctggcagccagagaagcctgaggacatccctctccatccctccctttccgcatcagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccggtgagccggctgggccgggctgggatgggcgggcatctgagccgagctgctcctgaccctgctgccccgccttccagctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtttttgggtttgtgccagacttggttgggaatgcacagggttgctggcctgggacctggggtggacgtcagggccttgactgcctcagggccccgacctgccaagagggccaggctcaggccagtcagcttgcccagggcctccaggggccgctgcctgctggcttccccagccctagggagagggctctgttctcatgggcagccttatcttattaacagcatacacacacaggcacacacagaatcacaggattctgatttctccattttcctgaagaggagatgggcctagagggccagtggattttgtgctaggtcaggcagctggaaacacaggtctagatctgggcctgggtctcctagcaaagcctttgctcacccagccccgcccagggccaaacacaggagcccaatgtttcctgagcatggatggcttttgagttttattaacaaaaatactctggtcccagaacaacagactggtgtggcctgcaccagtgtgtgtgggggggtggggattgagcccctccagagcccatggggaggcctggtaagtggggatgctggtctgtggccccatttggccaggcagagccccttccattcacacggaggtgagagccgggaaggggaagccggccccagctggactcccagcagccttggttaggctttgaagccagaggggggtgggagtgaaatcaaggtgtgaagttgagggggtgggtgggcaggcccaaggcggccatttggtgtgggggatggggccggtggaggtgagggggctccagggctgggggaagggagcgggaggtttgtgatggaggcagaggggcccagcagtggttcagtacatgggtttggagcccacatccagatagcccccaggcgcggtgtatggtagagggaaggggcccccttggagaaagtgcggggcaaagggtaccgccggtggagccgctgggtacccggagccccctgacccgtgcggcagctccagaaatgcagccgagtagggggctgagcgcccggagtctggagcctccgggaagctggggctcctgacatggagagagggatgtcagagcagggcagagggacccgcagccccgcctggtcccctgtcccactcacctggtgggaaggtgactgggggccccatggaaagccgcagggtgcaggaggtaggcctcagcactggggccaccacacagaggtgccggggcagcggtggcttccccgggggctggggcctgttctggatctgattcacgaatgtctccacccagggtggagtcgcagggaccacctggtgtgtctggggagagggaagggagaggttgggctagggaggatccctgtctcaggcctggccccatcgccatcgggactacactcacctccgctcccataggcctctgtggctgctggctctgggccccgcagtttcctcttcacacgggcgtctcgctccctggggaacagtggtggtgatgatgatgatgatggtgatggccatggtgatggtaacagtacttacccggtgccaggcatttcaccctcccagggaccctgtcaggtaggggccatcattatacccattttatagatgaagaaactgaaggccagaaaattaaataactagaaagtggcagagctggaattttgtccctgctcaaatttgtccatgctttcctattgtgtttagtatcagtggaaactccttcccagtggcaaggccagggcacagtctcacctagctcatctttctgccccatctccactctcagcctctctctggaatcctcttctgtcccctcttcacgggctgaacctgtcctttttcttttcatttttaaaatttgagatggggtcttgctatgttgcccaggctggagtgcagtggcacagtcacaggtcacagctcactgcagcctccaactcctgggctcaagtgatctttccatctcagcctccgaaagtgctgggactacaggcatgagccaccaaacctatccttgcctcactgcaagcgcaagttcctcaaggaagtcctccctgacctccgagagcacacacccctccctcataacatccgtcacagttctgcttttgcatttgatggagtgactccttggttcatgtctgtctcttctgacaaactggaagctacttgagggcaggggccagctctgaggtgctgcacttggaacagttcccacggccttacggaacctttactgtccgacataacctggcttcccctcccctgcctgactcttagtcactccactgcagccacgccacaggcacagccccacctcagggcctttgcacgtgctgttcccactccctagtgtgctttgccagatgcccacctggctccctcccgtacttccttcagctctttctcaagtgtcttcttcccactgaggcctttccaggcctcttatctaatacctcaccccagtccttcctatcttttcctggtttatttctcttctcctttttcttttttttctttttttttttttttttgagacagagttttcttttctttctttttttttttttttttgagaggaagttttgctcgtgttgcctaggctggaatgcaatggcatgatctcgactcactgcaacctccacctcctgggttcaagagattctcctgcctcagcctcccaagtagttgggattacaggcgtttgccaccatgcctggctaatttttgtatttttagcagagacagggtttcaccatgttggcaggctggtctcgaactcctggcctcaggtgatctgcccgcctcagcctcccagagtgctgggattacatgcgtgagccaccacacctggtctctcttctctttagaatggcttcctaacagatgacattttatttatttctcttgtctgcttgtctactctccccactagaaatcagctgcatgagggccggggctttggtttgctttgtttgttttatctccagtgcctggaactgtccctggcacatagcaggtactatataagtatttgctgagtcagtgaatgaatgttttcacttaccactgcatttctgatgtccagcacggtgcctggcacacagtgagtgattaataaacatttgttgaatgcatgaacaaatgaatgaacaactcccacctcttacagtttctgccgttctcccggaagcctttggcaaagggattggctgcaatcttcagttgtgtgatctggggacacacatgcagggtcaaagcaactgcggtctgggcagggggccaccaccccctcaagcagggtcactcacctgtgggttctggtaggctgtcacggagatgaatgtggtctcggggaagcggaaggaggccatgcccccccagtgctggctgcagagctgggctgcccgaactaggtgtatgcggggttggtacttgtgcatggagtgcaggatcagctgggagggaggaaatgggagtgattccctgccctgcgcctcacccttggcctcccttccagcaccccccaaccctatcctggagtcccagcctgggcctcacgtggccgtgggggtccagcgtgctgttggtgagcttgacacgatggaaagacacaggctgccgcatccaatgtgcaccagtggcaggagagtcggggtgaatgtagacacggtcaggcaggcggggctctgccttgccgctgggctcccagcgccggccctgccagcggtagcgagccccatccaccggaatcacatccagaagaaacaagtagcgggcctcggggtccaggccagtgactgacactcggcaggcagggaacatgcgcctgtgcaagggaggggacaggagaggcctggagctacccactggccaggggtgggcccagcaccagtaacgggacataacaacgggctccccagagctgtcagagaaacatcaaaggaggtggaattagaacccagagggcaggctggaggctgtggctcacacctctaatccctatactttgggaggccaaggtgggaggatctcttgagtcaggaattcaagaccagcctgggcaacatagaaagaccccatctctacaaaaaaattaaaaaattagccaggcatggtggtgcacactgatagtcccagttactacagaggctgaggcgggagggtcacttgagcctgggaagtcaagactacagtgagccacaattgcaccactgcactccagcctgggcaacagggcaagacactgtctctgaaaaatgaaaaagggccaggcgcagtggctcatgcctgtaatctcagcactttaggaagccgaggtggaaggatcatgaggtcagaagtttgagaccagcctggccaatatggtgaaacaccgtctctactaaaactacaaaaattagccgggtgtggtggtgtgtgcctatagtcccagctactcgggaggctgaggcaggagaatcgcttgaatccaggaagcagaggttgcggtgagctgacgagatcgtgccactacactctagcctgggcaacagagcgagactccatctcaaaaaaaaaaaaaaaaaaaaaaagaagccagagggcggaatcttagagctggaaggttttcttgtctcattttacatttggggaaacaggacagacgggttaagtgatctgtcacacagcaggttaggaacagagccatgactcctacccctcaaagcctatttgcagaagcaggggtgactaactttcttgctaggagcttcctgtccccaccctcctctcctcccctgatctccagcaccagaatctgcagctcttagatgaatttgctttagaaaaaatataccctgcctgcagtagggccgaggactttccatgctagggcttgagttcctgccccagctaaagacctcatctaaggtcaaacactgaccgtgtccctgcctctagggtgaccctggacctagtcatatactgactcctattcgagttgcatactgatcccgaatcctggccagatttccctgatgctggtcaatgggctggcccttgaccccctgtccttgtctggatgctggtctaagccacacactaacctataacccagagggacttcctgaccctgccccagactgacccatgacccttgccatagattggtccctaaactcagccacagactccacagactggcccttaacccttgtcacagagtgactcctgattcctgccacagagtaacccttgccccaggccatagtcagattctaggcctaggcagagctctagcccctcgggaaccacccagtcctagccccctccccagggactctgcctttcccaagagacccccaccagaaacacggaccctggccagcccctcacctcccagctttggtgatgatcatttctgttcccacagagctgaactccttccatagctcccggttctccaggctcaggctgacccccgggagggaatggagggcctctggagctgatggggccggctcagtgcccatggcagggggcagaaggggcagaggtgggtgcgcggccagggtgcggggagcagcctccatcccggagaggaagcaatccagtttaggggtgtccagttctggaagccggggaagaatgaggagccagccgagggccacagcccccctattctcctacccaggagctggtcccaacgctcaccggggtagcggtagccctccgctagggcgggtgggaagctggagtcggccccaggttgggcgggccccaggcggtagccggcccccagggacgggtacaattctcgtggatggtacatgttgtagttccgtctggcctcaggtctcgctgcttagggcccccggtgctgcgagatgccccctttatagctcacagctcagccccttccagatccaggatcacagcccctcccctctttggggccctggagttgggctggggtggagacccctggggcctcgaaggggtccgagagggggtcggatacctgggtacggtcccctcctcccctccctccccaccccgggaggcttcattagcctcgaccccctgccccctcattacataattaactcctcggcttgattgatccccagggctcggacagggacgcagtttggcgcttccggccagctggtccccgttcccacggtggggagccccggctagggataagctggggggcggggcctggaacctggacggagccaagagtcccgggacacaccttggcgccccagaccttctggcaggtgaccgccctccgccccccttcacttggaggccgggccctggagggaagcagcgtgaacagagggaaagtgcaggctagagggacgcggcctgagctgatttcacagggcactcggggccgcgaggaggccgcagcccagtcccgagcaccgtagtcctccctggtccccatgctaaaaaaacctccatcccgagccaagcctccaaagttcgaaggcgctcacagtccgacagcttctgacgcctcgcgccagggtttcccgaaggtcccgcgctggggaaccctcggaactacacttcccggcaggctcagcgctgaggcgcgcccgaaggagccggacggaccacgcgggggccgctgggagttgcagtccgaccgcgagggggctgcgaggccggcggcgcggttgcctccctgggacgctgcccctaggcggcggccaaacgctgcagatgagcagacgcagatcagccgaggtcacggcgtaggcagccagagtgggctcaggacctccgccagcagtgaaaccgtcccggttcccggagacccagcttggacggctgtgcctaccccatgccccgccggggctcagaaccgcacaggtctataggggcggaaatctccgcttgagctcccccttcccggattacacgcgagcctgagctgtctccactccattgttttattatgtacaaacgctacagaacgagggggacagacacgcgtggggtaagaagggcctggtgggaggagttcacagagcagacggtgcactgggaccaggagagcagaacacaggccataactatagggcaggtggggcaggaacgggttaaaaacgagatccaagccagccagatcgcaggaggtgcgggggcgtcgtcccccttctgttctccccccaaggtcacagtgcatgcaataaaatatatatacaggagctagatccgtcctctgcaggggctctgagggtccagagctcccttcgggtggcgggaagccagtggcgctccctggcggccaggccgggctggagccacatgcgtcgggggagcgggggtcagtcccagccgttgtctttgatcatgtggttgagttcaatgatgtacttcccctctttgtacttctggctgctctcaaaggcctgttcctgaaaggaggggcgggaccgtcatccccggagcaacagtctcaccacaaggcactggggttgggaagtggacatgagtggccccattttacatatgaggaaactgtggcccagaggggcagggccgtatttctcacaaacacagagtagaatagaactccctgactcaaaggtacttttttaagtactaatgatggctccaacagagaagatagggaagtggctaaaagatttcacagttcagggtttgcaaactggtagcttcatggccattttggcctacaacatgtattatgtttggacagcagacagtttaataaaaataactttaaagtattaaaatataagtaggccttgctcactccagtttgcccagcctgcccccaactcccaaccctgccaatctatgctaccctttacacatctacagtatctgcttggccttgcaggcacttgaggtttttttgtttgtttggttttgagagggagtcttgctctgtcgcccaggctggaagtgcaacggcgcgatatcggctcactgcaacctccgcttcccgggttcaagtgattctgctgccttggccccgagtagctgggattacaggcgcccaccaccacgccgagctaatttttgtatttttagtagagatggggtttcaccatgttagtcaggctgttctcgaactcctgacctcaggtgatccacctgcctcagactcccaaaagtgctgggattacaggcgtgagccaccacacccagcctggcacttgagtttttgacctcttgtttaggccagctctttattaattattattatttttgaaacggagtctcgctctgtctccgctcactgcaaggctctgcctcctgggttcacgcaattctcctgcctcaacctcatgagtagctgggactagaggcgcccgccaccacacccagctgattttttttttttttttttgtatttttggtagagatggggtttcaccgtgttagccaggatggtctcaatctcctgaccttgtgatccacccgcctcggcctcccaaagtgctgggattacaggtgtgagccactgtgcctggccggccagctctttatttggtagaggtccagagtggccaagccacctgtccagagacacacagccaatctgtggcagggtcagcagcgagctcaggtcagggctggctggctggctctgcctgggacatccacctcacagaggcaccacagttccaagcgacgcctgaagaatcctgtcccttgcagtgtcccaagagcatcttcctgagcatctaatctgatccctgtaacaatcctgggtgctaggcagtggctttatcttccactgagagataaggaaatgagactcagggtagtgaaatcagaccctggacagcagcagtggcaatgaggactatggaaagggaggctggtgaacccaagctccatgttgttgcagagtctggggcaatttttctgatactctaaatgacaatataagctggtgaccaagggtttggagtgaaaaaaaaaaaccaaccaaccaactcagattctggtccctattctgttacttaccagttgggtgatcttgggcaagttacctaacatctctgggcctccctgtcttcttctgtagagataataatagcttctacctagaggatcactgcaatgattgaatgagataatagacgccaggcacacaacagtgcaaggcacataaacattccataaatggtgactctgattatatcctaactctctaatggggatccaagtgcctgggagagaagggatgggttaagagaaaagttctacaccccttgcaaggtgcaagataaagagaatgtggtcagggatgctgacttgtgtgagctcggcctatgcaatctgaaaggctatagggtgacagcttgtcaggaggaggtgttggaaggtcaggtcaaaggctagcctggggtcagaggtgggtgactcacatatttccagcccaaagtggtcttgcagttctcgcagtggatgtcggcgacagcatggaggccggtcagcagcacccgctcctcggctggcccgcagcccacgttcaccctgtggggacatggggtagtcccagggagggtcctgccatcacagggcccaccccctcaagcactgtgtctgtcctcagcatccaagaaatgatgctcacaatttcctgcctgcaccggggaactctgggagtctcagcaggatgccaggggtcacaggtcacaacagaggtcagggaaagcaagaagggaggccagatactcacactgagttgaagaggtaggcacgcccctgactgccctggaaggactaaagggtgagagggtgggaagagaggagggggtcagggctgccggtggggagctgccaggcagcccctataggttccagccccactgtggcctggttggttaccttggagatgaggtcgtcgtggttggccaggtgagcgcggcagtgggcacagctatacctccggtgacaatcatccaagtaggcctgaaacgtcttgggctttgaaatccgcaccatggcgggggccgggggcagtggccccacgcggggagcggcccacggggagcagagggagcccagtgcctgccggggagggagtaggtgggctgtcaggacctgggccacacacatgcgaggcactcccagagccgtggggactcgctctgtcacactgggctgctctctcctttccccagagccagcagcctctccggggaccagaggcgtctcggttttgactcagtgaggaggcctcaggttgcatccatggggaaactgaggctcggaggtgcccagggtgagtcacccgcctgcttccggcctcacccttgctgacctggcagctgaagctggaggaaggggctttggaggggctgggctgtcagttcccagtttcgggggagcatgggcgggtaggcactggttggtccttgcgacctcatctggagagcagtggggttcactggtggtttagggggttcatcggggagagggtcccccacctggaggaggtaggaggcctcgccgtgaaggttgagggtcacctaggaggggaggggctctcacctgcgggcgccaaggcctcctctacgctcaggggctcttacctgcaacgcggagccttacctggactccggggctcacctggggcgcgggggtgggggcgggcgccgggggagggggcagtcctcgcgggctgggcaggggcgcggggcgacacgcagccctgacggcgcgggcctcacctcgcctgggcgcgcggggcccggtccgccggggtgggctggcctgggagtggggggcgctcctggcgggcgccgtcccccccgggcccgggttcgcaggcgcctggacttgtttacaccgagcccagctgctgccgccgctgcggcgggagggggaggggacccgcctcctgtcccggcggccgccgtggccaatgggcgctccgcatgcaaatgagggggcgcgtcacacggcggccggcgcaggccccgaccgcccctcccccgccgcccgctcccgccggcccggaaatgcggctgcggcccgcgcgccccaggcctgctcgcattcctgcttgtggcccgcgcaggggcggggtcggaaggtctaggccgggcgcggagcgaggaagcgggtggcgctgggacgcatgctctgggggagatgagtataatgacccgcgtttgtccgccgcccgtgccccgctcaatccccgcatcaatcccgtgaggccgtttctcccgttggctccactgtaccgggggctgaggcccagggaggtctcgcggctccctaggttatccagctagtaagaggcgaagctggaattctcactgtgggcccattccatggcttttgccagagcgccagggacacactcagttcaccttctagcagggaagacccaaagatgcgcgcccctggcagccagggcgtcggaccaggcaattcctactgtccagcatcacctcctccaggcctctcggatgcctctgttgggacagctaagttcctcttcaaagactcaatttcctggtcataagctgtaaacagattctactcccgctttttcttctttgtcgcacgtctaccctatttgggaaagtttaaaccttagccaatcgggatcagctcagattgtgcggtccaaccccccagccaatggggaaaggacacagaaacaggaactgcgttagggttaaaaaccacttccctcctttgttggcgggtgctcttgggattgcaaccagcgcaagcagcacccttctgcagaagtaaagatgccttgctgggaagtcttctgtctcagtgctggtttttcttgactacactgagcacttgttttcaacaaatttgagggtcttctgggatcccattctcctttgggaggggtagcgattacttttcctcgtgagacacgtcccactgccttgttgcagtggcccaaggagcggaggatcgggtccacccaaagtgaggaataaatccggactttcagcaacgtgggcaggaaggagccttaaaattcccaggcaagtgggtaactctgtgcacagaccaaggtaagaaaagttgctactggggcgacaaagtatttccttggtggttggggtcacttggaggttgaaagtgcatggctgagacatgtcagtggacacgaatcgagtgtggagtccagacttggttccatggtcacctcataaggcttagggcggttttccagtcggggattataccgacccgctaatgctaagaggggcctgaaattcccacgagggaagcggccaaaaagtacgaagcgattattcatatgagtgcaagaaacctccaatgggaaaagggagaggttaagcccctaggaaatgggcaccaacctccagaatgggaaataccccaagtaagacagggagtacaaaaggccaagcagacaataaaattccccctgacagtcctctgggccttatgttagagtactggaggtataatgaaagaaccatgtaacacaaggaaagacagtgaatgataaaatattgctgttttatttggaccaaagaacctatcctcagaccctcagtcttttggccaaagtttggatcagacgaggattggatatgccaactcttaatccagtatgttaataaaaaaagtccagtctctcaagaggaaatagattatgctctgtgttggagacaggaacatgtccttccctttcccttaaaggatgacgtaaaagagaaaccaaactcagtaccctcctaggacaacccagttaagtcagattctacatctaaagatgccaatgtataggatcccctagaccatcttcccccgcctaccccacctcaggctaatcactcagtccctcccccacataaccctgccctgtgggccttgtggccccacatccccattgagcagccacccgaacatgtcctttcctcaggaaaactccagcacgagatggaacaatgccggagggatattcagaactttccttttccctcttcctcaaaggggtctgccccaaccccttttcccttaagtaccactgggaggagggggtattggtttcgtaaatgcccccttaactagttcagaggttagaaatctgaaaaaggaactcaaaccattatcagatgatccttttggagtcacagatcaaattgaacaatttttagggccgcaattgtatacttgggctgaattaatgtccatcttaggtattctcttctcaggggaggaaagaaccatgatccgcagggctgctatgatagtctgggaatgtgaacaccctcttggtcaaaacatccctgcagcagagcagaaattcccagcccaggaccctcagtggaataggaacaatgcagcccactgagaaaacatgaaagacctcagggatatgataattaaagggattcaggaattggtgcctcaaacccaaaatatttctcgagcatttaatgtacaccaagaaaaagatgaagggcccatggaatttttaaagacacttaaggagcaaataagaaaatattcaggcttagacatagaggacccacttggacaagggatgttaaagctctattttatcaccaacagtcggccggacattagaaagaaattacaaaagatagaaaattggcaagactgctccatagaggaacttttaattaagagaggctcaaaggccgggcatggtggctcaagcctgtaatcccagcactttgggaggccgaggtgggtggatcatgaggtcaggagatcgagaccatcctggctaacacggtgaaatcctgtttctactaaaaaaatacaaaaaattagccgggcgtggtggcgggcgcctgtagtgccagctgctcaggaggcttaggcaggaaaatggtgtgaacctggcaggtggagcttgcagtgagctgagatcacgccattgcactccagcctgagagacagagcaagactccgtctcaaaaaaaaaaaaaaaaaagaaagaaagtgattaactctgatttgggttccaccgtcagatttatttattgatttattgatttatttattaaaaaaaaattcccagggaagtggtcaggagaaaacgataccctattcccttagaagctagaatggctctaaaacctataattgagggcctcgtccatgacggaccccttgaaccctgtatgtccccttataacactccaatattgcctgtaagaaagtcagatgggtcataccggctagtagaagacctctgggctgttaatcaaacagctcaaactacccaccctgttgttcccaacccttacactattatcagcaaaatcccatatgatcaccagtggttcacaatgatagatttgaaagatgccagctgggcacggtggctcacacctgtaatcctagcactttgggaggctgaggcgggcagactgcccgaactcaggagtttgcaaccagcctgggcaacacggtgaaaccccgtctctactaaaatacacacacacacacacacacacacacacacacacacacacacgccaggcatggcagcatgtgcctataatcccagctactcaggaggctgaggcaggagagttgcttgaacccaggaggctgaggttgcagttagccgagatcgtgccactgcactccagcctggcaacagagccaggctctgtctcaaaaaataaataaaataaaaaataaaaaaagaaagatggcttttgggcttgccctttagcggaagacagccgggacatgtttgcttttgagtgggaggaccctcacttaggtcgaaaacagcagtaccagtggacagtcctaccccaggggtttacagactccccaaatctattcggtcaaattttagaacaagtcctagaaaacttttcccttccttcatccatatgcctactcgaataggcagatgacctgttcatttcaggaaatagcaaggaccacataaccacagtttcaattaacttcctgaatttcctaagggaacaagggttacgggtctcaaggagtaaaattcagtttgtagaacctgaggtaaaatatctaggacacctaatcagtaaaggcaaacggaaaatagtacctgaacgaattgaaggtgtcacatctctacctttgcctgaaacaaagcaggaacttagaaaattcttgggattagttggatactgtcgtctatggattgactcttatgcctgaaaaacaaaatctctacataaaaaactcacccaagaaggaccagacccccttctttggaccctatcagaagtccaacaagtagaagagttaaaacacctacttgtaactgcccccgttatagctttgccctccttagccattccaccttttcatcagtgtaaacaaggggttggctttaggggtactcacccaaagacacagaggccactggcagcccatagccttcctgtcaaaagttcttgacccagtaacccaccgatggcccgaatgtgcccagtctgtagcagcaactgctttgctaatggaacgaagcaggaaaataacctttgggggaagcctcattgtatgtacccttcatcacgttagaaccattcttaatcagaaggcaggaagatagctcactgactcaaggattttaaaatgtgaggctatcgggtgggtgtggtggctcacgcctgtaattccagcactttgggaggctgaggtgggcagatcacaaggtcaggagtttgagaccagagtgcccagcatggtgaaaccccctctctactaaaaatacaaaaaattagccaggcatggtggcgcacgcctgtaatcccagctacttgggaggctgacgcaggagaattgcttgaaccccggaggcggaggttgcactgagccgagatcagccactgcacttcagcctgggcaacagaacgagactccatcctccacccaccccccaaaaaaattgaggctatcttattagagagggatgatttaacattgaccactggtagttcgctcaactccgatgttttcctaacaggaaatccgaaccgggaggaacctgagcataaatgtttagatctgatcagttatcagactagagtcagactgcatctaagcaagaccctgttccaaactgggcattacctctttatagacggctcctctcgggtaattgaaggaaggaggcataacgggtgctctgtagttgacagggaaaccctcatggaggtagagtcagggagacggcccaataactggttcactcaaacatgtgaactctttgcattaaatcaggccttaaaatctctgcaaaatcaggaaggaactatttacactgactccaagtattttggagtagtccatacctttggaaagatctggactgaacgaggcctcattaatagtaagggccaggaccttgtctataaagaattgattatgcaagtactagaaaatcttcaactgccagaagaaatagtggtggtccacgtcccaggacaccagaaaaacccatcttttgaaaaccggggaaataacctcacagatcaagtagccaagcaagttgcctcttcctgagaggcacccattttccatctgaccccttgccttcccctccagtcgcaatccccatcttctccgacgcggaccaagaaaagttaaaaagaataggagctaaggaaagctcagagggaaggtgggtattaccagacgggagggaaatgctgtctaaacctcttatgagggaaatattatcacagctttatcaagaaactcactggggtccccaagctatgtgtgacacagtcctcaaagcctatgggtatataggaatctctaccctcgctagtcaggtggcggatagttgcctagtgtgcaaaaaaactaataaaacccgaaggaagcagcctttactttatcaagggaaccacccctataattgccaatccaaccagtgcaacccagtacttacctctattactacccctacctccaccgaccctaactccactctaggttgcttctatggcttaggagccgatgttactggaagggaccctataggcttctttgaaatatgttttgttcacccttctccacctcctaccgtctccccctccccaagcccaccaaatcaaaccattcctcacctcttacccaatgacaaaaccaaagtagctatagtagaagtcaaggacttaaagcaaaccctagccattgagaccgggtatcaagatgcaaatgcctggctggaatggattaaatattcttttcgcaccctgaataaaagcgattgttactcttgtgcagcgggcaggccggaaacccagattgtcccctttccactcagatgggccaaccaaccaggcatggactgtatggtagctctcttccagcacaccacagcctggggaaacaagacgtgcgccactctttcactacgtttcccaaagatcaggagccctacgggtcagctcccaaggaccatttgacttccacctctcaatgccagttacaccttgtgtctcccacaacaggacaaattgacgttccttggaaatctaatgggagtctaaaccttttcaagagctaaccaatcagtcagcccttgtctatccccgagcagatgtatggtggtattgtggactgttactgggtacgctgccaagcaattggagcagcacttttgctctaatccagttggccatccctttcaccttggcatttcatcaaccagacaggaagcaagtaacccaaagaaaaagagaagcccctcgtgggcctttgacccccatgtttacatagacagtagcagggtcccacgggagctaccaagtgaatttaaagcttggaatcaaatagccgctgggtttaagtctgttttgttctggtggtctgctataaataaaaatgtagactggataaattatatatactacagcgagcagcgattcgtcagttataccagggatgccatcaaaggaatagctgaacaattaggccccaccagccagatgacctgggaaaatagactagcccttgacatgatattggcaggaaaaggcagagtctgtgtcatgatctgagtccaatgttgtacttttatccctaataatacagccgccgacgggaccatcacaaaagctttacaaggccttaccaccctggcaaatgaattagccgaaaattctggactagataacccttttatgggtctcatggaaaagtggtttggaaaatggaaaggactcctggcttcaatctttacctctcttgcaattgtaacaagtgtacttatccttgtgggctgccgcatcataccttgtattcgtgggttaactcaaaggctcatagaaacagccctcactaaagccttcctctcttctctccctccatacttggacaagctcttgctcctggataatcaagaagaacaacgaagccaaatcctgttaaaattttttgcagaggaagaagtatcaaatagaagagaggaaattgttgggacagctaagctcttcaaagactcaacttcctggtcataaacttctccccgtttttcttctttttcgccagtctaccctgtttgggaaagtttaaaccttagccagtcgggatcagctcagattgtgcagtccatccccagtcaatggggaaaggacacagaaacaggaactgcgttagggttaaaaagcccttctctcctttgtttggggtgctcttgcgattacaagctgcgcaagtagcaccgttctgaagtaaagatgccttgctgggaaatctgtctcagtgctggtttttcttgactacactgagcacttgtttccaacacccctgtgctccaggctgggttaggtctgatctcagggaatgtctgtttcaacacgtgtctgcagttctttggcttgtgttgctcactgcagtgggcccagcctggtctagaggaggcgctcaggaagtatctgtgaaatgtgaatgtgtagttccttcagtgaatatggccctggggctgaagatggcagaagcattctgggagcttctggagaaggagacctgggaggagaaggttggaatggcgggggcagcagaggggctgggtgaactcagctgtcccacccaggcccatcctctgcagcccgagaaggaagctcacagggcaagacatggaagagatcaagttccctgcccggtgcctgggctgttgatggcctcaggaaaatggaaccattacctgttgctgtcaagtggctgggggccaggatgcctgggttggccgtgagaggacattgctgaggagagtggaggccaggctggggtggggtgtggcaggaggacaggaatgcagtggaaccagtgggtcaggctcctgagggccccaggctccagcctcagggctggcctgttccctcctaagctgccatcttcatatcttcaggacccacccctctactcctcaccctcagcacaacgatgtgatcgaaaggcaaatatttatttttcaggaagagaaacaggagacctcgaggcttctggacttaggaggtccgggcagctggtccatggttgtccaggtagtgccgcagggctgtgggataatccgttatgacgccagtggctcccacgctgaaggctgcttcaaaatccgactcttcattaaggcaccaaaagaccacctgagcagggagggagggggcctgtagattctgaacaattttacatctggagagtggggacccacctcctcctctatggagactccccagcagcagtaggctggagctgattgttaaattctcaggaattttgcaaagtggttattaaacccagccattattaaaaattaaatcatagcctgggtgcagtggctcacgcctgtaatatcaacactttgggacgccgaggcaggagttgaggccaggtgtttaagatcgagtgagacctcatctctacaaaaaactttgtaaaaattaattagcccggtgtggtggtatgcgcctgtgctcccagctacttggaagactgaggtgaaagaattgcttgagcccaggactctaaggctgcagtgagctatggttgcaccactgtactccagcctgggcgatacaacaagacctcgtctcaaaaaaaaaaaaaaaattatatatactgacaattaaattatttatttatttatttatttattttttgagatggagtcttggtttgtcacccgggctggagtacagtggcatgaactcggctcactgcaagctctgcctcccgggttcacaccattctcctgtctcagcctcctgagtagctgggactacagatgtccgccaccacgcccagctaatttttctgtttttagtagagatggggtttcaccatgttagccaggatggtctcgatctcctaacctcgtgatccacccgcctcggcctcccaaagtgctgggattacaggtgtgagccaccgcgcccggccctaaataaattattaaaacaacaagtggccaggcgtagtggctcacgcctgtaatcccagcactttgggaggccgaggcaggcagatcaactaaggtcaggagttcgagaccagcctggccaacatggtgaaatcccatctctactaaaaacagaaaaattagctgggcgtggtggcgggcgactgtaatcccagctactcagaaggctgaggcaggagaatcgcttgaacccaggaggtggaggttgcagtgagctgagatcacgccattgcactctagcctgggcaacagagcaagactctgtctcaaaaaacaaaacaaaacaaaaaacaaaacccaaaacaaacaaaaatccagtaataaatattcaaagcatatctcttgctaatcagtttcctattactgtgttcttgaagtgattaagtctgttgaggctgcaagatggaaatactacatgatggggtgccaccatgcatctcttcccattctgcatttagtggcttcatgtcggcagcctgaaactggccaagatgggagtatttaaaccaggaaaattaatcctcaaatcagggctttcatttgttcctctctgagagctagttgttgaccacttaacagcaccaccctcccccaaacccccattccactgccacctgccccagctcctgcagctctgccccttccctgcccgttgagtgggcactgaggtaggcggagatgggaattttttatttaaaaatacagatgagacgaggtctctctgtattgccaacactggagtgcagtggtgtaatcacagcccactgtagccttgacctcctgggctcaagtgatcctcccacctcagcctcctaactagctgggactacaggcatgcactaccatgcccagttaatattttatttatttatttatttatttttgagacagtcttgctctgtcgcccaggctggagtgcagtggcgtgatctcggctcactatagcctccagctcctgggttcaagtgattctcgtgcttgagcctcccaagtagagctgggattacaggcatgcgccaccatacccggataatgtttacatttttagtagagatggggtttcacaatgttggccaggctggtctcgaactcctgaccttagttgatccgctggccttggcctcccaaagtgctgggattgcaggcatgagccactgcaccctgcctctgcatttttcttttctttcccttttcctttcctttttcctgtttccctccctctcctccctctccctgtctctggctctcacgctctttcctctctctcttttgagacagtctggctatctctcccaggctggagtgtggagtgcagtggcgtgattctgattatagctcactgcaccctcgaaaccccgtgctcaggtgatcctcccatctcagcctcctgagtggctgggactacaggtgtaaaccactgcgcttggctaatttttaaattttttgtagagacgagggtctcagtatgttgcccaggctggtcttaaactcctgggctcaagtgatcctcccaccttggcctctcaaagggctgggattacaggtgggagccgtgcccagcctctgcctatggcatttcttccctgtacccttgatgggaagctcccacccctagtaccatagtgcctggaacattctcaaggatcgtttactaattaaatgatctggtggaagccaatgctcaggggagaggggggtgggctgggcctggtttctcccatctctcatctttccccagccccctctcatcagggatcatgatacatcattgttgtcatcataatggctaacatttatcaagcccttaataagtactagttacatatccatatgttggcaatgtcaggttaagaaaatatgtgcgtggccaggcgtggtggctcacacctgtaatcccagcactttgggaggctgaggcaggtggatcacttgaggccaggagttcgagaccagcctggccaacatggtgcaaccccgtctctactaaaaacacaaaaattagccaagcatggtggcaggcacctgtagtcccagctactggggaggctgaagcaggagaatcgcttgaacccgggaggtggaggttgcagtgagccgagattgcaccactgcactccagcctgggtgacagagtgagactcttgacacacacacacacacacacacacacacacagaagaagaaaattgtgtgtgttcgtgtgtgtgtgtgtgtgtatccagagagttaaatataccattttcccattttagggacgaagaaactgaggtgaggtcacctgcccgagtgatgcagctagttggcagcagagtgggaccggaaccctgctgccaggtctgtgtgcggtggaagtggtggtcacggcctcacctgcacccctcgctcctccaagtgtcggatcagactcttcctcatgatcagcctgggggtggggtggggacgtgggaggtgatgatgagaggggacctgggagaagggcagcagtaggtctctatggggacacgccacccagccatcttgcccacctcaccatttcgaaaccacagccaataactggttcaggcaagagcaggaaaatgggaaataggtcctgcagagagaaggaagtgggggttagctcctagggtctcccctgtcccagaggtggggtgggctggtagtgcccccgccaactagggtagcgctgccctcccaccccccagaatcccccagaataacctttgtagttgccccagtgaacaattcacccattgttcagagagcctactctgaccaccacgcttcaagggtgtggccctccagtcaccattcaccagataaggaatctgggccttagagaacgaaagggacttgccagacccaaagcagagtggtggtggggctgggccagggcctcgcttggttccaaagctggacatccaggctgcaggccctcctggttgggcctggccagcttcttatttatctatttatcttattattaatttaaattaatttttttttttttgagacagagtcttgctctgtcgcccaggctggagtgccgtggtgcgatcacagctcactgcaagctccgcctcctgggttcacaccattctcctgcctcagcctcttgagtagctgggactacaggtgcccgccaccacgcctgctaattttttgtatttttagtagagacagggtttcaccctgttagccaggatggtctcgatctcctgactttgtgatccgcccgccttggcctcccaaagtgctgggattacaggcgtgagccaccgtgcccggccattaaaaaatttttgtagagacatgtctcactatgttgcccaggctggtcttgaactcctggactcaagcaatcctcccgcttcagcctcccaaaagtgccaggataataagcacgagccagccaagtgtggtggctcacacctgtaatcgcagcactttgaaagtctgaggtgggaggagaccagcgtggccaacatggcgaaacgccgtctctactaaaaatacaaaaattagccgggcgtggtggcagaccctgtagtcccagccacttgggaggctgaggcaggagaattgcttgaacccaggaggcggaggtttcagtgagccaagatcgcactactgcactccagcctgggccacagagtgagactccttctcaaaaacaaaaaacaatggccgggcgcggtggttcacgcctgtaatcccaacactttgggaggccgaggcgggtggatcacctgaggtccggagttcaagaccaccctgaccaacatggagaaaccctgtgtctactaaaaatacaaaattagccaggatggtggtgcatgcctgtaatgccagctacttgggaggctgaagcaggagaatcgcttgaatctgggaggcggaggttgcggtgagccaagatggcaccattgcactccagcctgggcaaaaagagcaaaactccgtctcaaaaacaaacaaacaaacaaaaaacccacaaaaaacctcgtgagccactgtgcccattggccagcttcttgagaccagacagcacttagtgggacgacccctaattatcccactccaggggtgactttagagacccttgacagtgtcctagggcaggctctggagtcagacccagggaaaacctaagctctggatttccagctgtgtgtccttgggcaaattacagaacctctctgggcctcagattctctagggtaccatgggagtcatgattcttatacctcctgggggtgctgcaaggtaaaagtcaacccaaaatatgttaaaacactttataaatcttgtataaggccgggcgcagtgggtcacgcctgtaatcccagcactttgggaggccgaggcaggcggatcatgaggtcagattaccatcctggctaatacggtgaaaccccatctctactaaaaacacaaaaaaattagccgggtgtggtggcgggcgcctgtagtcccagctactcgggaggctgaagcaggagaatggcgtgaaccagggaggcagagcttgcagtgagccgagatcacgccactgcactgcagcctgggcaacaggggaagactcctcaaaaaacacaaaaaaaatccggtataaaaaggtggtacacaaatatcattgatctctttgtagcaaggtattgtgggggctgagtgggacttccttctggacaacagaggggagcagagagctctgggactaccacagagaagctgtcagaaagcaaagggagaccgggcccaggggctcaggtatgtaatcccagcactttgggagaccaaggtgggaggctcgcttgagctgaggagttcaagagcagcctggtcaacatagtgagaccttgtctctacaaataatttaacaattagccaggtgcagtgttgcacgcctatactcccagctacttaggaggctgaggcaggaggatctcctgagcccaggaggtcgaggcgcagtgagtcatgatctggccactgcattccagcccgagcaagactgtctcaaaaaaaaaaaaaaaattgtaaagcaaagggagggactaggcttaagtgccagcgaagtatccaaattcctgatcctttccccagctgttactttgttaacccctgccttcctgcagaacactgacttggccttttcctgctgagggtctgagacagccgtgctataattaatgaacgaatgtctccccagccagactgtaagctcaccaaggacctctccccaccctcactggtctcatttacacattataactgcacctgggacagagtagacattcaataaaatatgctagatggcctgagatggataaattacctctctatcctaaaactccacatatgcacagaatttcagggtgttcacagttcccttagtattcatgaatgctgggtaagaaccactgtccttaaaagaccttgggggttatctctgaggggagctggggagctgggaagatctgggctccttctccacggagaccctaagcagtggggagtttttctgaggtccgccccccactggtacctgttgatgatgttgggcaggaagcagaagaagaacttctcagggattgggatgaagggcagcagccccaggtagtaggaaagcagcacccagaatcctcggcttattgtgaaggacaggggcatctcggggttctggggaggcaaggagaggcatgagaatctgtctgctctggggaagcagagaggaggcatgagctgcaggggagccgtggtgggcattccagaggccctactacctgcaggatccaagtcacatcttggggctgggtgtggtggctcacgcctgtaacctcagcagtttgggaggctgaggcaggtggatcacctgagatcaggagttcaagaccagcctggctaacatggtaaaaccccatctctactaaaaatacaaaaattagctgggcgtggtggcgtgcacctgtaatcccagctactcgggaggctgaagcatgagaatcgcttgaacccaggaggcagaggttgcagtgagccgaggtcgcaccaccgcactccagcctgggcgacagagagagactgtgtttcaaaaaagaaaaaaaacaaaagtcacatcttggctctgtgttcgaggcctgagttcacacccttttcattgccaccgccacgccactgggaactctcccagacccctctagctcgggtccccatgctgggtgggctccagctctggggaggaggggcccctggaggaggaagaggacgggggaggggtggggggactcacggcagccttgcatttcttcatgaccgagctcttctccgaggcccagatggtgatttcattacggtcatagcgtctcaccaagcctgctatctgggaggaggagaaggaggtgaagggagagccaggcctctctcacgcccccggtggccgccctagccctgcctgcagcaccacctcacggatgagctcttcgttcttccctttgatctctacgctcatgggtgtccttggaaacctctggaacaggtcctccagacgaaccatgcgccggtctgacccgtgagcaaagtggcctgggggtggtgtgggaaaaggggtcagagggaagccaaggcggaggtccaaggaaggcaggcatggcccaggcagggctcgaagcccttgctctcacctggagagaagtaaacctccagcttctccttgtagaggggcaggtcctggggaggacaggaaggatgtcactagaggcccgcattgggcatggtgactctcagggtgggggttggggtgtcagggcagggcccacctcgaagtccaggctgcccacatccctgtttaggcccgactggcggcacaggttctcatcatgtgacaccaccaccactctgtcccgtgtcagctgacagtcgagctccaggaggtccgagcgctgggccatggagctgtgggggtgaaggtcagcggggggcaggggcaggggactgggatgaggggcatggtggctgggaggtggccgggaatgtgagagcggagttcgtggcgggatgtgcaggccacctccagggggcgccagtcacccagctaggaagtgaatggcgtcccttgctgtgatgcagtccacgacctgcacaccctcacatggcagcctgggcaggggcagatacactcacttctccatggcctccatggtgttctccagcagctctccagatcctgtggggggcactggagtgggcctctggggcttggggtctaggggcctggcccaacctcatcacccacattccctctctgggctccatcctccctctggcctcacctccccagccagcccaggctgcgccagcatcttcttcctcgtccacaccctgccctgccacttcgctctccttctctcttggtccctgccccgtttctagcatgcccccttggacctacccctctgtgctgtccactttggcacctgttctcacccctacccggctcacctcctcggtgggcccccaggcggatgcggaaggtgggagccctgggcgtgtgcagcagatgaggccggcgcaggaagaagatggagagcatggcatagctgcccagggcagggagggcatagtacagcaaaaggctcatgaccgtactcccacagaagctcctgcagccacacgctcagccgtccgcgggactgtgctgcctgcctagccagtgtgggccggctctactactggccactgccacgcccctgggacctgctgagcctgccgctgggctggcttggagccaggctgcagggttcggctgaagctggggtagtgtcaggaggtgaggcaagtagccctggctctcatatccccaggcccttcccagcccccagcagccccgtcctgggctacatgaggggagtaaaaaccacccaggactgtcaggacctctccctctcactggtacttgtagccagcgcatccaacatgcctaccccttgccatttcagaggatccaggggtgtgtagggtgctcctgagtcaccccgaatcacccccagccagttagacaggaagccattagcgagaggacaggacagtgactaaggggaaaactgacccccttctttctaggagtctggagctctccagagccccgtccccagccctgggcagctgggagtgaagggcaccaggcccctgaaagcccaagtcaagtctgtcctcagagccgcacggggcagggcgggggcgtcgcgaacacagacagagccagggtcagccatagacacatctctatatttatatattagacgggtcagggaggtggcaggggcgccgggctctccacgccccccagctccacttctgctcaccacacacagaagcagcgagggcacgcgaagtgacagctttgacagggaggggattcggcccggcctggctcctcagggatgctagcccttgagactaaggaatgttccttcagggaaactagggtggggtttgaatgagatgaggggggcaggcatggccctgagtccctactcagcgccccccaccctccacctctgcccttcagcaggttggggcagccagaacccttccattccagaactgccagagactgggacgctggggaaggtaagggcgcagcagcagcagcgggagattgaactggggccacctgaggtcccgaggccccgtggggagggcgggtggggaggagaaggccttggcctgcctgaagctggaggcctcagcaaaggagagaggtggccaggcccatgctccaccccggcctgggctgccaaggtccgggctgggcacagtgtccattttctaacagtctggcgggagaggggcaggcaggaggcaggtcctaaagagagaagcaggcagaagaggagtcgttagcaccccccgggcagacccactggagccctgacctcaacatctctcatttcaccctcacagctggataggctgggtctcagtttccttatctgtaaatggagataataatagtacctagcttgaggtactgctgtaagattaaaggaattaatacatgtaaacctcttagaacaatgcttagggctttatgctttcattattagaactgtctcggccgggcacagtggctcacgcctataatcccagcactttgagaagctgaggtggtggatcgcttgagcccaggagtttgagactggcctgggcaacatagcaagaccccagctccacaaaaaaaaaaaaaaaaaattagccggttgcaatggctcgtccagctagctgggaggatcccttgcacccaggagttttgaggctgcagtgagctatgattgcaccactgcattccagcctgggtgacagagcgagacactgtctcaaaaaaacaaaaccaaaaaaaaagataaatagattgactccggaaactgaggcgccgagaggtgaggtgccttgcccaatatcacacagcacttactaagtggcacagctggagtttgagcccaggtgcgcatgccttctttctatcaggccacacctggctgaagacaggaagagaccggaggaggcaaggaggcagcgtgggtgggggcaggccagtggggtccccacagctatgtgaactgctgatctggcagcaggtgtgaggaggcctggcaatctgggtcaggctgggcgctgctgggcccctcccaaagcaatcatggccccacctgcttctgccacacccagagctgaagcttggctcaggtcctcacctgggtgacagaggccctcagtgacctcttgcctctttgccagttctgttcctagaaggagattagaatggcttgtggggctggaggatgcaaggtgttgacaggcagagacatttggggctggaggactcggtgggccaccagtctgggcagccttgggcatttttttttttttttttgagatggagtcttgctctgtagtccaggctggagtgcagtggtgcgatctcggctcactgcaacctctgcctcctgggttcaagcaattctcctgcctcagcctcctgagtagctgggattataggcatgtgccaccacacccagctcatttttgtattctttacagtagagaccgggtttcaccatgttggccaggctggtctcaactcttgaccttgtgatccacccacctcggcctcccaaagtgctgggattacaggcatgagccactgtgcccagcccttttttttttttttttgagagagtctcactgttgcccaggctggagtacagtggtgcaacctccgcctcccaggttcaagcagtcctcccaccacagcctcctgagtagctgggactagaagcgcatgcctacgtgcccggctaatttttgtatttttagtagagacagggtttcaccacgttggccaggcaggctggtctcggactcctgacctcaggtgatccacttgcctcagcctcccaaagtgctgggattaccagagtgacccactgtgcccggctaatttttgtatttttagtatagatgggatttcaccatgcaggccaggctggtctcaaactcctgaccctcaggtgatccactcctctcagtctcagtctcccaaagtgctgggattccaggcatgagccaccacacccagccccctgggcacttctgttgtcaccagacacattgaccatgggtgtggggtaagcttgctgctgtatggaggcatgtacagatagatatagatatagatatacagatatagatatttagtatcagggtgtccatgtgtgggccatggagacactcaccaggccccagggtgcagagatgtctgtctgggctagggggcctccagcactccgggctggaagcgtgctgtctcctggaagatgagctccttcagccgctccttaggtaggtcatccagctccatggcgaaggtgaagggctcctcggccactggctggggtggtagagacagcaaggctcaggcctggcatgggggatgcctacgtgcccccctgctcccctgcccccagccccactgctgctggggactggcccacctcatccgtcgggtcatagtactgctccaggtaggggtgagccagcgcttcctccactgtgatccgtttattggggttaaaggttaacatccggtccagcaggtcaagggctatggaagggcaggagtcaggggtcacagggaagactggaggagctccgagaagcattgctttgcctgtctcctccagcggctgctgggctcacacaccctccacgacacccaaggtttatcccacacccaccctcatgtctctcgaacctttggagtctgacttggggaaaagcttggcccaagccaccttggtcttggagggcagagactgtaggtagtttcgggccttcatgttgatgatacaattcaggtcctcctgggatggggagcccaggatgcctgtggataaggaggtgacttggtaaatgatcacctctttctttctgggaacagaataggcaacaaggcaagaacaagaccccccagcccagcaacccatgccaatccctcagtcacctcctagtcattagcatggtggtgcagagcaagggggctgggttcaggcagaccgaggctcaaatcctaggtctggtgcctcctcaggtgtgggacttagccttgcttttcccatctatccaatggggataatatctatacctcattgagataccatgagatgctggaggcaccccacacgtggtggtatccctgacttggactctcgagaaatctcacctcggaaaagctaatcatccccaactcagccagccgggcctccctcacccagaatgtggttgagctgatccaggtagtgcttgccagggaagatgggccggttagagagcatctcagccagaatgcagcccacagaccagatgtcgatggacttggtatagccctgggggagaggaggaagtggtgagctcctgggccagcctcaacagggtcctgttgtctgcgccaggccaccacctccaagttagatccaacaccaggcagaaggcagaggcctggagggctcaatgctcagcttccttgcagagcccaaggcccagagggtagaattcctgtgtcatgggggtcagtgtctggctcagaggtagctccagggcttcctgggaactggtccgttcctttcaggagtgggcagcccctcctaccttggagttcagcatgatctctggggcccggtaccagcgcgtagccacatactccgtcaggaagccggtgtggtcatgctcaggatcggcaatccgggccaggccgaaatcacaaatctggaatcagacctagctgctaagctcggcgctcaaggcctctgcagcctaagcagtcacgcccccttgtctttgcctccactgttccctttgcttgcaatgttctcctgcccaaggcttcttctactggtcactggaagccccagaccctgggggaggaggggacaggtgcccaaccctctgaccttaaggtcgcaggtggtgttgatgagcaggttggagggctttagatctcggtggagcacgttggcggagtggatgtacttgaggccccgcaggatctggtagaggaagtagcagatatggtcattgctcagctgctggcttttcagcaacttgtacaggtcagtctccatcaggtcctgcacaatgtagctgaggatggttccgcagacccccccaggcagggggcagtgggaggcacttggttaaggaaaacaggctctgaaggcgaggctgcacacctcctccagccagggcccctgggactcaatagatctgccaacctgcaccaccagctggggaagctgctgccattacccagcggcagggctctgagcctctgttgcatcacagttgctgatcctgagcaaggggcttcatttctgaggcctcagtttccctaccggggaaacggggataataataaactgtgggaggcaggagaacttcacagttaagagcagcaacttgggccaggagtggtggctcacacctgtaatcccagcactttgggaggctgaggcgggaggactgcttgaggccaggagtttgagaccaccagcctgggcaacatggcaaaaccctgtctctactaaaaatagcaaaattaactgggcacggcggcatgtgcctgtaatcccagctactcaggaggctgcagcacgagaatcacttgaacccaggaggcagatgttgcagtgagccaagattgtgtcactgcactgcagcccggatgacagagtgagactctgtctcaaaaataaataaattaaaaaaaaaaaaaaacctacaaaaagagcagcaactctggagttaacccatggatgtctgaaatctcctctctactactcactggctttaggatctcaacctgtctgtgcctcaactttctcatctggtatgtaggggaaataatgtttttttgtttgtttgtttgttttctttttgtggagatgggctcttgctctgttgcccaggcaggtcttgaactcatgggttcaagtgttccttccacctcggcctcccaaagtgctggaaattacaggtgcaagccatgaaataatggttcttttgagggtggttgtgaagactagatgagatggcgcatgtaaagctgtcagcccagtgcttggcaagttgtgagtgctaggcaaacatgaactattattactaatatgaatgcctgagtcacatggctgttgagggagttaaatgagataatgtatgaacaccatctggcatgcaataaatgtttgcttaaaaataaatgcctgccttatgggaatggtttgtgcaagaaaaatgaggagacactcccaacagcacactcccactcaaaggagagtgcttggccatacctcagaagatggaggagtaaaatgtctttttctatttgaagatacaaaaaagcttatgcgtaaataaataaataaatccacaaatgctgtttggcttgtctctagaaaaataagtcagggctgtcttttagaatctgccttgagaccaggcatggtggctcatgcctgtaatcccagctcttcaggaggccaaggtgggttgatgacctgaggtcaggagtttgacgccagcctggtgaacagggcgaaaccccgcatctactgaaaatacaaaaattagccgggcgtggtggcaggcgcctgtagtcccagctacttggaaggctgaggcaggagaatagcttgaacctgggaggtggaggttgccgtgagctgagattgagccactgcactctagcctgggcaacagagggagactccatctaaaaacaaacaaacaaaaaacaaagaaaacaagaatcagccttgaaagggtcttcagagaatatgtggaccagccctgctgttttagggctggggaggcccagcgagacgcagtgacttgcttcagatcacacagcgagctgggggtgagcacggagatttcctgtccacagtttgtggtgggggttgcagacacctcagtacaaatccccactcttgggtggagggctgggactgagagtgggtgggtggggcagggaagaagtgacaggtgtcataagttgctaaggagagccagacaggaagtggacagcaaactaggaaagcagtattgggggaggacagccaaggctaggctgtccctccctgggcaaggtgcaagtccacaggtgattagggtgtggctctgagtgagaagtcctaagaagaaggacaagttcccatctgggggaggagaggaggagacagcaacagaaacacttgattttaggttttctgagccttagcttcctcatctttttttttttttttttttttgacagggtcacgctctgtcccccaggctagagtgcagtagcacaatcatagctcactgcagcctcgaactcctaagctcaagccatcctcctgcctcagcctcccaagtagctgggactatagtcgtgtaccaccaaacctggataatttttaaattttttgtagaggtggggtctcactatgctgcccaggctggtcttgaactcctggcctccagtgatcctctggtcttagcctcccaaagtgttgggactacagatgtgagccattgcactccacccctcatctttgaaatgaagctgaaaagcccatctcatagggtagttgggaggtgtaatagaaaaaaaaaagcattgggcatgtatagtacctgacacacagcaggccctcaagaaaggcagttttttgtttttgtttagttttgagacagagtctcgctctgtcacccaggctggagtgcagtggcacgatcttggctcactgcaacctccagctcctgggttcaagcgattctcctacctctgcctcccaagtagctgggattacaggcttgcaccaccatgccccgctaatttttttgtatttttagtagagatggggtttaaccatgttggccaggctggtctccaactactgacctcaggtaatctcccacctcagcctcccaaagtgctgggattacaggcgtgagccaccacgcccagctgacagttttctttctccctgtctcccttccggtctgggcaaggaggaaagagaggaaagaatcatccattccttagcaagaagtgactgtgggcagaggccaggtcatgtctcagaactgccgacgtcagaagacaccactcccatagagaccatcctgcctagcccttccccctggggcacagagcagagaacccacttgctcgaggccatactgcctgggccgctgcaggcctgggttcatcagaggtctccaagtcctgttacactgtggcttcccctctgcaggaaagtttattttactgggtttgttttggagggtggtgggtaagatggaaacagaaaccaagcaacgggtccccagcccagctgcgaggccgtgcctgaccagccgactggccaaggtgaaggatacacatctctcatggcttccagggtggacgcccgcagaatgtctcggatgccgatgacattctcatggcggaagcgcagcaggatctggatctcccggagcgtgcgctggcagtaggtctgatgttcgaaggggctgatcttcttgatggccacgcgagtcttgcgcacgtggtcataggccgagctgaggggaccggagagaggctgctgctgtggccttacaaagggggagtccgggcctggtggccccacccaggccttggcagggaggggagagagcaggagctggctctggtcaaatcataaacaatgctggttccttcctgctgtggaggcctgggatctccagagagaaagctggggaccagccaggcggcccttcggtgactttacaaacagaggaagagactgaccgctcactgacttcccctctcctcaatccccttccattctactggccctgaacccttcgcccccattcccaggaaaggctccttaacccaagacaggtccgggggtgcagatgctggggacacaccatggggcaaatactgggaaggtggcagccaggggaggggcaggagagaatggacagggcaggggagggtcccagggtgagggatccgggcagcggggctgtcccagagggatagaggcccagagcacacggtggggccgggggcactcacagacccctcccaaaacatgcaggtggcactcctggccgcctcatctctctctgggcccctggggtggtggggccaaagccctgccccaccctgatctcggctcttctcccccaggctccctggcactgcctcacagggggaatccaagacaccctttcccccaaaacgggccctccactgcctcttcactaaggatgtcgcctccccgagagtactcatcctctgggcctcgccccgtgtcactagggtccccgcgggcccccacatgcactcggatgcccctcccatcattacagaagggtggactcaaagcctccaagcctgctcccctgaggacgtaggcagcgccccctcccccagaaagcactcaggggccccctccctgggacgctcccgatcatcccgagtctcctgcctcctcgggacgctccgcgtctccacgtcccggaaagcgctcggcgcctcctcctcctctcccgcgaagccccctcccctgagggcaccccctcccccggaacgccccctcacctgaccatgccgtacgcgccctcgccgatgtactgcaactgcgtgtagcgcgggcccacgtcgaacggctgccccttcaccatctccacctcccccgggacccccgggccgaccccctcggttctacggggctccccgcccccgcccccctgagccgccgccgccgccatctccactcctcccctcccaccgccctcctccccacggcggccccgcccgaggccccgccccttcccgcctgcctgtcacccgcagggccgcgcgcgccaggccccgcccttgccccggccccgcgtgggcctggagctgtcacgtgacccgccccgcgcgcgcccgcccttcttgccccaggttcgggggccatgggtccctgcgggctccgcggcctccaggtcaccgggaggttcggcagcgccgcctcggagactgtcctcaccctcccctcgatggcgaagcggccagggcgtgacctaccagagccacccagccaatgtatgcggcagcccaccagaacctgggcccgggatcaccctaggttaaaaataatgttctaataaatggatcaaattttacagatggagaatctgagagttaggtttactaacttgggtaaggtcactagtagtgacagctgagactcaaaatggtgtcttctgacacagagactctttctaattccatgcctctcagagtcctagactgtttttattttattatagagacagggtctctctctgtcgtccaggctggagtgtagtggtgcaataattgctcactgcagcctcaacctccctggggtcaagtgatcctcccacctcagcctcccaaagagctgggactacgagtgcgcgccaccacgccctgctaattaaaaaaaaaaattggggggctgggcacggtggctcacgcctgtaatcccagcactttgggaggccgaggtgggcagatcacctgagtttgagaccagcctgaccaacatggtgaaaccccgtctctactaaaaatacaaaaattagctgggcatggtggcacgtgcctgtaatccaagctacttgggagactgaggcaggagaatcgcttgaacccgagaggaggaggttgcagtgagctgagattgcaccacttcactccagcctgggcgacagagcaacactccgtctcaaaaacaaaaaacaaaaagaagaagagaaaaagtagggttgcagaaggtagggactgaagaaaggcatgaaggagaaggatcggggtgagctgaggcataaaggcagaagcataacttgtccagcatggctgcagtaaaaaaatgatgaggtttcagcctggagaggtaggttggggccagattaggaaggctctggattctggcaaggagtttggatgttactcagtaagcagtaaaaaccctagagggacttttgccagatcattttgcaactgcgggagaatatagtgactcagagaaaacactatggagttcagcatggagccaggtttgctgagtgggagtgagtttcccagcataggaaaggctggtgtatcagagctgcaagctgccacctcctgctgctggaagctcagttagagtgtgactgagattcccctctagtgactgaggttggcatttccttggaggactggactgggatttgttctggttcatagacgcatattcaactaatgtagacttaccatctcttctgtgccaggcacttttggtttttttttgtttgtttgtttgtttgtttttttgagacggagtcttgctctatcacccaggcaggagtgcaagctcactgcaacccctacctcctgggttcaagtcattctcccacctcagcctcccaagtagctaggattacaggcgccagccaccacgcccggctaatttttgtatttttagtagagacgaggtttcaccatgttggccaggctggtctcaaactcttgacctcaggtgatccacccacattggcctcccagagtgctgagattacggcacctggcttgccaggcacttttatgtacactacctcctgtaatcctcacagcagccatatgaagtagatactattaacatttaactggaaaatgatgctggctggtcgtggtggctcacctctgtgattccagcactttgggaggctgaggcaggctgattgcttgaccccagcagctggagaccagcctgggcaacatagtgagatcccatctctaccaaaaatacaaaaatgagctgggtgtggtggcatgcgtccgtaatcccagctacttgggaggctgaggcaggaggatcagttgagcccaggatgttgaggttgcagtgagctctgatggtgccactgcactccagcctgggtgacagagtgagagaccctgcccccacccccacccccccaaaaaaagggacagagggaaaacgatgtggaagcttacgctctgtcacccaggctggagtgcagtggcgcgatctcagctcactgcaagctccgcctcccaggttcacgccattctcctgcctcagcctcctgagtagctgggactgcagacacccgccaccatgcctggctaattttttgtatttttagtagagacggggtttcaccgtgttagccaggatggtctccatctcctgacctcatgatccacctgcctcggcctcccaaagtgctaggagtacaggcgtgagccactgtgcccggcagaattatttttctagcacagggtcttgctctgttgcccaggctggagtggagtgtagtggcaagatcataggtcactgcaggctcgaactcttaggctcaacagatcctgccaccatgcctagcacacacaaccacgcctagctaattttttttttttgtttttgaaacggagtcttgctctgttgcccaggctggagtgcaatggtgcaatctcagttcactgcaacctctgcctcccgggtctcctgcctcagcctcctgagtaggtggaactacatgcgtgtgccaccatgcctggctaattttttgtatttttattagagagggggtttcaccgtgttagccaggatggtctctatctcccgacctcgtgatccgcccgtgtcggcctcccaaagtgctgagattacaggtgtgagccactgcgcccagcatttttttttttttttttgagatggagtctccctctgtgcccaggctggaatgcaatggcacaatctcggctcaccttgacctctacttcccaggtcaagcgattctcctgcctcagccttacaagtagctgggattaccggcacacgtcaccacgcctggctaatttttatatatttagtaaagatggggtttcaccatgttggccacgcaggtttcaaactcctgacctcaagtgatctgcccactttggcctcccaaagtgctgggattacaggtgtgagccaccgtgcctggcttggctaatttttagaatgtttgtagagaagggttctagctaatgttgcccagtctggtctcaaatttctaggctcaagtgatcctctcacctcggcctttcggagtgctaggattacagtcatgagccacttcggctggctccagattaaatcttaaaccagttattagctttttgtgattttcaaggtctggcacttctttttttctttctttctttctttttttttttttttgaggcagtgtcatgctgtgtcgcccaggctggactgcagtggtgcggtcatggctcactgcaacctctgcctctcaggctcaaatgatcctctcacctcaaccttctgagtagctgggaccacaagcatgtgtcaccatgcccagctaattttagtatttttggtagagatggggtttcaccgtgttgcccaggctggtctcaaatgatccgcccaccttggcctcccaaagtgctgggattacaggcatgagccaccatgcctggcctgaaatagttatttattcttcttattattagtagtagtattctggtctttcatgaccgtagacttttgaagattataggtcagttattttgtagaatgtccctcagtttgggtttgtctgatatttccttgtgattctcatgtcactttgcctttactattgtattgtatcgagacgaggttcaccatgttacccaggctagtcttgaactcctggtctcaagagatctgcccaccttggcctcccatcatgctgggattacaggtacaggtgtgagccactgcgcctggcctttcttttcatttcatttctttccttttttttgagacagggtctcgctctgttgcccaggctagagtgcagtggcatgatcacagctcactgcagtctcaacctcccaggctcaaatgatctcccttcctcagcctcccaagtagctggcactacaggtacacaataccacatctggctaattctttttgtatttttattaggatgggtttcaccatgttggccaggctggtctcaaactcctgacctcaagtgatccacctgccttggcctcccaaagtgctaggattacaggtgacagccactgcgcctggcctaattttttaaattttttgtagacacgacagtctggctatactgcccaggctggttcttttttttccccctgagtcagagtcttgccctgtcacccaggctggagagcagtggctcgatctcaactcactgcaacctccacctcctgggttcaagcaattctcctgcctcagcctctcgagtagctgggattacaggtgcccgccaccacgcctggctaatttttgtatttttagtagagatggggtttcaccatgttggccaggctggtcttgaactcctgacctcgtgatctgcccgcctcggcctcccaaagtgctgggattacaggcatgagccactgcgcccggccccaggctggtcttaactaggttcctttctgtctgtctccttcctcctcagatatgcctaaaacatggccctgatgaggttgtagtaggcaggaatctttcagtaacaagtcttcaaagacccaactcaaaaggactcaagcaagaaaggaggtgcattggcttactgactgtgaagacacagttggctccactgactcaaacagtatcattaggactttgatccctcccttagctcaactttcttctgagttggttccattcttagccaccccctcctctcagagtagccagatggaagctagtacttgcagattcgtgtctggttttttcagtaactccagcaagggaaagctcttctctctctgtctctctttctccctgtctctgtctcttgtaatgcaaggcctagatttgactcttattggttactagtttttttgagacagagtctccctctgtcacccaggctggagtgcaatggtgcgatcttggttcactgcaacctccaccttctgggttcgagagattttcctgtttcagcctcccgagtagctgggattacaggcgcccgccaccacgcccggctaatttttgtatttttagtagagacggggtttggccatgtgggccatgctggtctcaaattcctggcctcaagcgatccactcacctcagcctctgaaagtgctttgataacaggcatgagccaccgtgcctggccagttactagttttgtttgaagcctgtgcaaatccttcaacctgaatcagtgtggaattgggggtttagttatctctactggcatgacataaagtaggctagggaagggatggttttcccaaggaaaattcgggcaccatccccagaaagtgctgagcagacagttacagcagtgtctattataatatatatatttttaattcctccccccacctttttttttttgaggcaaggtctcgctctgtcccccaggctggagtgcagtggcaccatcatggctcactgtagactcgaccacccaggctcaggcagttctctagcttcagcctcccaagtagctagaactacaggcacacaacaccatgtccagctaatttttgtatgtatatatatatatatatatattttttttttttgtagagatggggttttggcatgttgcccaggctggtctcaagctcctgggcttgagaccagtcctccccaccagcctcccaaagtgctgggattacaggtgtgagccactgctcctggcctaattcctctcattaactaccaaatgaagtccaccacccctggctaattttaaaaaattatttaggagataggggtctctccatgttgctcaggctggtctcgaactcctggcctcaagcaatcctcttgtttcaccctcccaagtagctgggattatagatgcaagccaccatgttcagtttagattgtacaatttcttttctttttttcttttcttttttttttttgtttgagatggagttttgttcttgttgcacaggctggagtgcaatggcacgatcttagcttatggcaacctctggctcccgggttcaagtaattctcctgcttcagcctcccgagtagctgggattacaggtatgcaccaccacgcccggctaattttttgtattttgttttagtagagacggggtttcttcacgttggtcaggctgttcttgaactcccgacctcagctgatcctcccgcttcagcctcccaaagtgctgggattacaggcgtgagccactgcgcccggctagatcgtacaatatcttgaaggccattatgctggtgtcttccctttgaagccctcttatattttgttggtgcaaaagtaattatggggtgggcatggtggctcacacccataatcccagcactttgggaggccaaagaggggtggattacttgaagtcaggagttcaagaccagtcttaccaatgtggtgaaaccctgtctctactaaaaatacaaaattagctgggaagactagtttcctagacggggtttcaccatgttgtccaggccgatctcgaactcctgaccttgtgatccgcccacctcagcctcccaaagtgctgggattacagccagccaccgcgagccaccgcgcctggccttattttttattttatcttttttagagacaggatcttgttctgtcacctaggctggagtgcagtggcctgatcatagctcactgcagcctcgaactcttgggtttaagtgatcctcccacctcagcctcctgagtagctaggactacaggcacacatacaccacccctggtggtgtgtgcctgtagtcccaaaccagtctgaaaagatagatgtgggggccaggcgcagtggtgatgcgcgtctgtagtcccagctacaggactgaggcaggagaattccttgagcctaggatttttgttttgttttgtttttttgagacagaatctcgctctgtcgcccaggctggagtgcagtggtaagatctctcagctcactgcaagctccacctcccaggttcacgctattctcctgcctcagtctcccgagtagctgggattacagacgcctgccaccacgcccggctaatgttttgtatttgtagtagagacggggtttcaccgtgttagccaggatggtctcggtctcctgacctcatgatccgcctgctttggcctcccaaagtgctggtattacaggcgtgagccaccgcgcctggcatgagcctaggagttcaaggctgcagtgagctgtgattgtgccactgcacttcagcctgagcgatagagcaagacctacaaaaaacaaacaaaacccaaaacagaatcacatgtaacacacagctgtggactgattggttgacaaaagtgtggtgatcagaggctggcaggaacttcaccatgtatttccgctagaagcaatgttcagtattctctaattcattgtttgtggtgactttggggaatataaccaccacagagacaagaatcaactttgaatgtgtcatcccaccacctgctggcttccgttgtttctgatgagaaatcaactgtcaatctcattggagtttccttgtacgcgatgagttgtttttctcttgctgctgccaagagtctctttttgtcttgtttgtttatttatttatttatctaatttatttattttgagatggagtttcacttttgttgcccaggctgagtgcaatggcacaatctcaactcactgcaacctctgcctcccgggttcaagcaattctcctgcctcagcctcctgagtagccaggactacaggtgtgcgccaccatgcccagctaatatttgtatttttttttttaaattttttgagatggagtctcactctgtcccccaggctagagtgcagtggcgtgatcgtggctcactgcaaactctgcttccctggttcaagcgattctcctgcctcagtagctaggattacaggcacatgccaccacacctggctaattttttatttttagtagaggcagggtttcaccatgttggccaggctggtcacgaactcctgacctcaggtgatccatccaccttggcctcccaaagtgctgggattacaggtgtgaaccgctgtgcccagcctaatttttgtatttttggtagagtggagtttcactatgttggccaggctggtctcgaactcctgacctcaggtgatccacctgcctcggcctcccaagggttgggattacaggtgtgagccaccatgcctggcccttggggtctctttttttatgaactgtctgtcccactgggcaaagcctctgagaccctattttggacactggtggagcagtagcctctggttttcgtggcttgcccctcctggcatgggatctctgttccacaagcaagctgggaggagtgtgattatggtcccagtattcttggactgtcactgatggtacagccttcattctatggtgtgggcgagtgctgggtggaggagaagagtgccctacttctttaccacgttcaccagaaatgtagcctcttcaatttggagttggaggggatgaaaactggtggcagcatgctcctcctggtgagatatggtaagccttgattggcagctgaggggagagggagcttgtcttcttggccacatctactcagagagcagtttccttccagctgaactgtggggggagggcagtcaggagatagttggtcctcctggcttaaatgccacagatggcctggcacagtggctcataatgttacaggtagttaaacaggcatgagcagggctggagagggctcttccccacccaccaggaatgtcaagtgatggttcaacaatgatcacattgcctctctaaataatttggcagccagcgccagagagagagacaagctcctgatggtccacagctgttatgttagagtgttaattgaatgcagacaccagggagaagcaatttcctggacatgtgcattaagagacaaaatagtctgggcacggtggctcacacctgtaatcccagcaatttgggagactgaggcgagcggatcacctgaggtcaggagttcaagaccagtctggccaatgtggtgaaacccccatctctactaaaaatacaaaattagccaagcgtggtgttgggtgcctgatatcccacctactcaggagactgaaggaggagaattgcttgaacccaggaggtggaggttgcagtgagctgagatcaggccactacactccagcctgggaaacaagagtgaaactgtctcaaaaaaaaaacaaacaaacaaaaaagaaagagacaaaatgatggagcatgaccttccggggtcagaccaccggaaaagggaagaaaacctcagataggcatgcatacaacttcctacacacactgtgcatgctcaccttcccagggtaaggaggccactgtgcatgcaggcagcccatcctaagggaagaatcatgggaaaggagccagcctataaagtcctaggatcaaggttgaacaccacgcttgaccttggtgcccacttgagtctcttccaaatgtacttacctttctttcccattctaaagccatttaaaataaacttccactcctgctctgaaacttcccttggtctctttttctgccttatgccctgtggttctttcttctgtggaggcaagaattgaggttgctgcagacccgtacagatttgtcaccggtaacttggataacctttcaccgataacaatgcttataatcccagcactttgggaggccgaggtggcaggatagcttgagcccaggaatttgagaccagcttgtgcaacatagtgaaaccccatctctacaaaataataataataaaagtaataaaattcaatgccacagattctccctgttcttactgagttttagtagattttcttgaataagaaagtgagccaagattgcaccactgcactccagcctgggcaacagagcaagactccatctcaataaaaaataaaattaaatgtttattcatctgttatatgacattaggataattccagaaactttaagtgtttatttatttttaaatggttttcaccagctttgcttgttttgctggggaaaagatcctcagagctccggcactgtcatcttagagctttgatgtcccccagtgtattaatccattcttgtattgctataaatacctaagcctggataatttataaaggcaagaggtttaattggctcatggttctgcaggttgtacagggaacatgatgctggcatctgcttggcttctggggaggcctcaggaaacttacaatcatggcagaaggtgaagggagaacaggcatgtcacatggcaggagcaggagcaagagagcaagggaagaggcgccacacactttacttattttatttttattcatttattttgagatggaatctcactttgtcacccaggctggagtgcagtggcactacctcagctcactgcagcctccatctcttggattcaagtgattcttttgcctcagcctcctgagtagttgggactacaggcatgcgccaccactggctttttttttttttttttttttttttagacagagttttgctcccgttgctcaggctagagtgcaatggcaccatcttggctcaccgcaacctccatctcccaggttcaagcgattctcccacctcagctgccaagtagctgggattacaggcatgcgccaccacatccggctaattttgtatttttagtagagacggggtttctccatgttggtcaggctggtatcgaactcttgatctcaggtgatctgcccgcctcggcctcccaaagggctaggattacaggcgcgagccaccgtgcctggccaatttttttttttttttttttagatggagtttcgctctcgttgcctaggctggagtgcaatggtgccatctcggctcactgcaacctccgcctcctgggttcaagcaattctcctgcctcagcctccctagtagctgggattacaggcatgcgccacctcgcctggctaattttgtatttttagtagagatggggtttctccatgttggtcaagctggtctcgaactcctgacctcaggtgatccacctgcctcggcctcctaaatagctgggattacaggcgtgagccaccacatctggcctaatttttgtatttttagtagagacgggcgtttcaccatgttgcccaggctggtctcgaactcctggcctcaagtgatctacccacctcggcctcccaaagtgctgggattacaggtgtgagccactgcgacccgccttcacacacttttaaacaaccagatctcttgagtactcactcactgtcaagagaacagcaccaaagggatggcgctaaaccattcatgagaaaccccacccccatgatccaatcacctcccaccaggccctacctccaacactggggattgcaatacgacatgagatttgggtgggcacacagttctaaaccacatccctcagcttttcctttcaggcttttgggttagtctattgcttgctccaacacctgtctactacttcagacagtctcaaagttaaaaatcctacctgttatccaatgaagtctccctgaaaaaaaatcttgcctgtaaatgtttctgatgaatgcctcctggggagagggccttttgcactgggccagctccagtgaggtcacatacagatggacttgcaagtggagtcttctagggaacctcaagacagctccagtaatgacagttctttggaaacacaactttgaaagaactccagctccgttttactccctcagggggctgccaggttgctctgagaatgtgggctgttattttttaaggttgcaacagagctggaggctgtgggctgggactagggcaatttttttttactttatttatgttacctttcttttttgagacagggtcttgctctgtcgcccaggctggagtgcagtggcacgatctcttctcactgcagtctccacctcctgggttcaagtggttcttctgcctcagcctcacaagtagctgggattacaggtgcacaccaccacgcctggctaacttttgtattttttggtagagatggggtttcaccatgttggccaggctggtttcaaactcctgacctcaagtgatccacctgcctcggcctcccaaagtgctgggattacaggcgctcaagccaccttgcccagccactttttaaaatttcttgaaagccacaacaagatttgcctatccccggtactttccccatttttaaaaatttctcaaaggtggtcttcagtggttccaaaactttatcttagaaactttcagcattttgaggggtggactgcatccaaatctggggtcttgaacatttcagttgagttagtgtcctattatcattctccacttctttggggcttcaatttccactgaagtgtggacctaaaagcattttaatcttgagtgtcattctctttacagaaaacacaggctgggcactgtggctcacgcctgtaatcctagtactttgggaggctgaggcaggcggatcacgaagtcaagagattgagaccatcctggacaacatggtgaaaccctgcctctactaaaaatacaaaaattagctgggcgtagtggcacacgcctgtagtcccaactactcgggaggctgaaacaggagaattgcttgaaaccaggaggcagagaggttgcagtgagccgagatcatgccactgcactccagcctggcgacagagcaaaaatccatctcaaaaaaaaaaaaaaaaaaaaagagagagagagagaaaacacaaaccaggcttgacacagtggctcattcctgtaatcccaggactttaggaggctgagacgggtgaatccttgagcccaggagttttttcttttctttttctttctttttttttttttttttttttttttttttttttttttttgagacggagtctcactctgtcgcccaggctggagtgcagtggtgtgatctcggctcactgcaacctccgcctcctgggttcaagcaattctcctgcctcagcctcccgagtagctgggactacaagcgcatgccaccacgcccagctaatttttttgtatttttagtagagacgaggtttcaccatgttagccaggatggtcttgatctcctgacctcatgatccgctcgcctcggcctcccaaagtgctgggattacaggtgtgagccaccacacccagccaagtttttttcttttcttttctttctttcttttttttttttttttcctaagacggagtctcattctgtcgcccaggctggagtgtaatggtgggaactcaactcactgaggcctctgtctgctaaattcaagcaattctcgtgcttcagcctcccgagtagctgggattataggtgcgtgccaccacgcccggctaatttttgtatgtagagacggggtttcaccctgttggctaggctggttgaactcctgacctcaagtgatctgctcacttcggcttcccaaagtgctgggattacaggcgtgagccactgtgccaggccgagccaagagttcaaaactagcctgggcaacataggaagactccagctctataaataaataaataagctgagcatggcagtgcatgcctgtagtcccagctacttgggaggctgaagtgggaggatccctggagcctggaaggtggaggctgcagtgagctatgattgcaccactgcgctccagcctggggaacagagtgagagagcctgtctcaaaaaaaaaaaagaaaaaagaaagaaaaaagaaaaaagagaaactaaatgaaagtggagagcttctgcttcctcttggtcatctgttcgtattacaacatctaccctaagcaatgggcctatttcttcctttttcttgatccagatatagctatcaaagccctttttgttgtctatagcatgttttgtaatctcagctcattccgagttacagccatcccgacactgttctcataggtttatgctcagcttttgtgtttatccctgggttacgcggctcttcttacatcttcttttattacagaacttcctgtgcagccgctttggctcctataaatgctattccgattgcctcttcatcaggacccaaaagggatgaaggagtggctggttttttggggaggcgggaggaggttggatattcttgaaatgataaataaaatgatacatattagttcagtattggaacacagataaatatttagcacatgcaatgagataattgttcattaatttagcatcctatgattaatttagcatcctaatagtcataggcattgtcttgttcacctcaagtacattaatacacaattacatactgctttttcccttagctttcatttatttacgactgtgtggtaaacgatcctaaaatttagtggcatgaaacaaccaccttttaaaattttttttcaaatgctcgttgattctgtgggtggagtttgggaagggcaaagtgggaaaagctatactctgctctgtgatgtctgagcctcagcctcagatggggtgacccgaacagccaacagtaactctaatggatggggagggaacagccggggctggggatctgcttcgcagatggctgctttagtcacatgcctgttgcctgcgctgcagtggcaggagggtaggctcaggcccaaaggggactgaaaaccacgcagcctgtgtgtaagggggcaacccgtatgcgaaagcacagttggactttttttttttttttttttttgagacaagagtctcactctgtcaccctggctggagtgcagtggtgtgatctcaactcactgcaacctctgcctcctgggttcaagtgattctcctgcctcagcctccgagtagctgccattacaggctcccaccaccacacctggctaatttttgtatttttagtagagatggggtttcaccatgttggccatgatggtctcgaactcctgccctcagaggatccacctgccaaagtgctgggattataggtgtgagccaccatgccaggccttttcttttctttttttctgaggcagggtctcagtctgtcacccaggctggagggcagtggtgcaatctcagctcactgcagtctctacctcctgggctccagcaatcctcccatctcagcctctcaactacaggtgtgcgccactatgcctgtctaactttttttttttttttttttttttgagaaagaatttcgctctccttgcccaggctagagtgcaatggcgtgatctcggcttactgcaacctctgcctcccaggttcaagtgtttctcctgcttcagcttctgagtagctgggattacaggcatgcaccaccatgcctggctaattttgtatttttagtagagacggggtttctccatattggccaggatggtctcaaactcctgacctcaggtgatccgcccgcctcggccttctggctaatttttttacagattttttgtggagactcagtacattgcccaggccggtctggaacttgtgggctcaagtcatcctcccacttatgcctcccaaagttctgggattacaggtgtcagccactgcacctggccggccggccttccttccttccttccttctttccttcctttcctttctttttttgttgagacggagtctcgctctgtcacccaggctggagtgcagtggtgcaatctcagctcactgcaacctctgcctcctaggttcaagcaattttcctgcctcagcctcccaagtagctgggattacaggcgtgcgccactgcgccagctgatttttgtattttcagtagagacagggtttcaccatgttggccaggctggtctcgaactcctgacctcaagtgatctgcccacctcagcctccaaagtgctgggattacaggcatgaatcacggcacctggcctcctggcttttctttttctttgagacaaggtctcactctgtctcccaggctggagtgcagtggtgtgatcattgctcactgcagccttgaactcctgggctgaagcaatcctcccatttcagcccctcaagtggctaggagtacaggtgcatgccaccatatccagctaattttttcaattttttgtaaagatggagtcttatcatgttgcccaggcttgtcttgaactcctgggctcaagtgatcctcccgcctcggcctcccaaagtgctgggattataggcatgagccgctgaagctgggctctataggcgtattatgaaaaaccagggctccttcatgacccatttcctgttccccagaggcaagaacgttccaccgctttggctgggccattggtattgacttccatgtctctaaacagcatgttcatattgtacttgctgatttctcggttttaggcactacctgttatcattttgaaggttgaggctttacaattcttccacctctccccgacagcccacatctctattcctacatatgcacgtgtgcacttcctgttttcattcttccatgtcactgtgcctcggttctgggtacacagatattcagagtctatatcctatagctatgtaaacactgttcacagctgaaccatgccctttccacaaacacttcttccctgcactgtttgttccttctttcccctccaccacactgagttcattatgtcacattttagctgctgtgtttttttgctatgtaacactagttcaatcctgaatgctaccttgagatgtcaatcctttatcacattcaaacatattccattttctattggttttatttcatattattttgttttgttttattttgagatagggtcttgctctgtaccggaggctggagtgcagtggtgcaatcacagctcactgcagcttcagcttcctgggctccaagcagtcctcccacctcagcccccagaatagctgggactacacatgcgtgccactacacccgactaatttttaaattttttgtagagacagggtcttgcaatgttgcccaggctggtcttgaattcctgagctcaagtgatcttcctgcctcagcctcccaatgtgctgggattactggcatcagccacctcgcccagctgcaccatgtatgcatttctaaacaggcttagttcctgcctgttttgggctttataagaacgcactcatggccagacacagtggctcacgcctgtaatcccagcactttcagaggccaaggtggatggatcatgaggtcagaagttcgagaccagcctggccaacatagtgaaaccctgtctctactaaaaatacaaaaattagccgggcatggtcttgcacgcctgtagtcccagctactctggaggctgaggcaggagaatcacttgaacccgggaggcagaggttgtggtgagccgagattgtgccactgcactccagcctgggcaacagagctagactctgtctcaaaaaaaagaatgcactcattgtaggctgggtgtggtagctcacgcctgcacgcctgtaatcccacactttgggaggctgaggcgggtggatcacctgaggtcaggagttagagactagcctggccaacatagtgaaaccccatctctactaaaaatacaaaaattggccaggcgcacatctgtaatcccagcactttgggaggccaaggcaggcggatcatctgaggtcaggagtttgagaccagcctgaccaacatggagaaaccccgtctctactaaaagtacaaaaaattagccgggcgtgatggcacaaggctgtaatcccagctactcgggaggctgaggcaggagaattgcttaaacccagaaggtggaggttgcggtgagccgagattgcaccactgcactccagcttgggtgacagagcaagactccgtctcaaaaaaaaataaataaataaaaagttaattgtgattgtggtagaatacacacaacataaatgtacctttttttttttttttttttttgagacagagtctcgctttcttggccaggctggagtgcagtggcacgatctccactcactgcagcctccatctcccaggctcaagcaattctcctgcctcagcctcccgagtagctgggattacaggtgtgtgccaccacgtccggctaatttttgtatttgtagtagagacagggtttcaccatgctggcctggctggtctggaactcctgacctcaggtgatccacccactttggccttccaaagtgctgggattacagatgtgcgcctggccaatttttgtatttttagtagagatggggtttcaccatgttggccaggctagtctccaactcctgacctcaggtgatccacccgcctcggcctcccaaagtaccatctgagccattttttagtgttcagttcagtggtgttgagtacattcacactgtggtgcaaccaatctccagaactcttcatcttgcaaaactgaaactctgaacccactaaacaacaactcccctctctcccctcccctcagcccctggcaaccatcactctactttctatctctatgactctgactccaggtacctcacataagtggaatcatgcagtatatgtcttttggggacagggttatttcacatagtataatgtcctcaaagttcagccatgttgtagcatgtatcaaaatttcctattttaaaaaaaattctgaataatattccactgtatgtaggtagcacagtttgtttatccattcaccctttcagcctctgtctttattattattattattattttgagacagtcttgctctgttgcccagactggaatgcaatggcgagatctcagctcactgcaacctccgcctcccgggttccagtgattctcctgcctttgcctcctgagtagctgggattacaggtgcccgccaccatatgcctggctaatttttgtatatttagtagagacggggtttcaccatgttgaccaggctggtctcgaactcctgacctcatgacccgcccgcctcggcctcccaaagtgctgggattacaggtgtgagccaccgctcccgaacctgtcttctatattggatgccttcctcaaacgtggtgaatcttgggggtctgtgcatactaaagctggagctattaaaagccttttaaaagttccccaggctgagggcacagtggctcatgcctgcaatcccagcactttgggaggccaagacaggtggatctcttgagtccaggagttcaagaccagcctgggtaacataacaagacctcatcgctacaaaaaataaaaaaataaagctgaccatggtggctcacgcctgtaatctcagcactttgggaggccaaggcgggcgggtcatgaggtcaggagttcgagatctgtctggtcaacatggtgaaaccccatctccattaaaaatacaaaaattagccaggcgtggtggtggatgcctgtaatcccaactactcaggaggctgaggcaagagaatcacttgaacagggaggcagaggttgcagtgagctgagatcgtgcctctgcacttcagccggggcgacagagtaagtctccatctcaaaaaaaaataagaaaaaaaataaatcaggcacggtggtgcacacttgtagtcccagataccaggaaggctgaggtgggaggacgatcgagcccacgagtttgaggttgcagtgagctgtaattgtgctactgcactgcagcctgggtgacagagtgagacccaatctcaaaaacaaacaaacaaacaaaaaaaaaacctctctccactgtgtggcactgtgtgctagggggtgaccttgctggtggcttcccagggagctcctgatgtcagtgtcttcaggactttcctcttggcttgatcacagtcccttcagaagattcttccaattcctgcctgaaggtgccaatttctatgtcttttgtggcttctgcaaagaaaacctagcaatttctcattttttccaatgccagctcgattccacttccttggttctagtaaattggttaccatgagtccctctattagtacctggcttaaacatttttgttcgtattgtcttctttcctattcttactcttcctgtgggtgtgtggcattagaaagattctcttactgccattttattatgtttggggcaagaacagaagtaaatacatgtgtttagtctactatctttaacctgatgccttttaacttttttttttttttgaggtggagttttactcttgtcacctaggctggagtgcaatggtgtgatcttggctcactgcaacctctgcctcctgggttcaagcgattctcctgcctcagcctcccgagtagctggggttacaggcgcctgccaccatgcctggctaattttttttttttttttagtagagacagggtttcaccatgttggccaggctggtcttgaactcctggcctcaggtgatttgcccgcctcggcctcccaaggtgctgggattataagcgtgagccactgtgcctggccccttctaactttttaaaagtaaaccttgtcttggttaggcatggtggctcatgtctgtaatcacaaaattttgggaggctaaggcaggaggattgcttgaggccaggagttagagaccagcctgggcaacagagtgagactgtctctacataaaatttaaaaaaatagccaggtgtggtggtacatgcctatagtcccagtgctttgggaggccaaggcaggaggatcacttgaacctaggaattcaaggccacagtgagctgtgattgcaccactgcattccagcctgggtaacagagcaagaccctgtcttgaaggaaaaaaaaagagttgtcatattcttaccacatcattatccacattatccacaaagcaaagatatggaatcaacctaagtatctatcaatggaggagtggataaatcaactatggtatgtatacagaatggaatactatttgactataaaacagaattaggctgggcatgatggcccacacctgtaatcctagcacattgggaggcgaacacaggtggattgcttcagcccaggagttcgagaccagcatggccaacatggagaaaccccacctctactggaaaaaaaaaaaaattagccaggcgtggtggcaggtgcctataatccctgctacttcagagactgaggcaagagaattgcttgaacctgggaagcagaggttgcactgagccaagatcactgcactccagcctgggccacagagcaacactcagtctcaaaaaaaaaaaaaaaagttttaatatctgatagcagagtagggtgattatagttggctgcaatgaattgtatatttcaaagtaactagaagagaacttgaattactcccaacccataggaatgagaaatactcaaggtgatgagtaccccagataccctggcttgatcattacacattctatgcatgtaacaaatactctcatggaccccataagcatggtgtatatatatatgacatatatgatatatcatatgcaacacatattatatcatatatgatataatatatgtgatatatcatatatgatatataatatatgtgatatatcatatatcatatataatatatgcgatatatcatatatcatatataatatatgtgatatatatcacatataatatatgtgatatattatgtatcacatataatatatgtgatatattatgtatcatatataatatatgtgatatattatgtatcatatataatatatgtggtatattatgtatcatatataatatatgtggtatatgtgatatatattatatatgatatgtgtgatatattatataatatatgtgatatattatatatgtgagatatatataatatatatatttcttttttagacagcatcttgttctgttgcccaggctggagtgcaattgcacaatcttggctcactgcaacctccgcctcctggtttcaagcaattctcctgccttagcctcccgagtagctgggattacaggcgaccgccaccacacccagctaattttagtatttttaatagagatggggtttcaccatattggtcaggctggttttgaattcctgatgttaggtgatccacctgctttggcctctcaaagtgctgggattacaggtgtgagccactgcgcctggcctggaatacattatgtatcaataaaaaaaaacaggagttgtgtggagaacaattggagcagcagatggcaaagaagaccttgagggctgggataagaagactggattttctgctagaaggaatgagagcattttatcatgttagtcagcttcagagccttgcagtaaaaacatttgcacatttgaatgttgatgaagacatttacaaatatagacaggatgtgataatttgtacttttccctcatccccggttggtgtgagtgatgtcattgattgcaccagttaacaggtgaaaaaatagaagtttgggatgtcaggattgtacctgatgcttgagcatcataggtggatgtgaaggaaaaggaaaacatgatcaagggctgagcaatctgggccacaggaatatcaaactcatttaccaatgtgtgcagccacccttaggctgcatgacagattgaggacagagcttatctgggcactcattaattgaaaggaggagatcagtgagaagaagtagagaaaacaaactacttgtcagttcaaacttaatcactttgttttttgagacagagtctcgcactttcgcccaggctggagtgcagtggcatgatctcggctcactgcaagctccgcctcccgggttcatgccattctcctgcctcagcctcctgaatagctgggactacaggcacccgccaccacgcccggctaattttttgtatttttagtagagacggggtttcgccgtgttaaccaggatggtctcgatctcctgaccccgtgatcccccgacctcggcctcccaaagtgctaggattacaggtgtgagcccccgcgcccggtcttttttttttttttttttttgagacaaagtcttgctctgttgtccaggctggagtgcagtggcatgatgtcagctcactgcaacctctgcctgtggggttcaagagattctcctgcctcagcctcccaagtacctgggattataggcacccgccaccacacccgactaatttttgtatttttagtagagacagggtttcacatgttggccaggctggtctccaactcctgacctcaggtgatccacctgccttggcctcccaaagtgctgggattacaggtgtgagccaccacgtccagctttttttttttttttttgagatgtagtcttgctctgtcacccaggctggagtgcagtggctcaatctatgttcactgcaacctccgcctcctaggttcaagtgattctcctgcctcaaactcctgagtggctgggattacaggtgcgtgacaccacgcccagctaatttttgtatttttagtagagagagggttttaccatgttggccaggctggtctcaaattcctggcctcaggtgatctgcccggctcaggctcccaaagggctgcgaatccaggcgtgagccaccgtgcccggcccggtttatattttagaagggtaatacagtaagttgacagtaagagagcccttatctcttttcttttccttttttgttctcctttcatattccatcattgaaaggtaggaacatacagcataacttaaaattaggaacagagttcacatataactttttttttttttttttttgagatggagtcttgctctgtcaccaggctggagtgcagtggcgcaatcttggctcactgcaacctctgcctcccaggttcaagcaattcttctgcctcagcctcttgagtagctgggactacaggcacgtgccaccacacccagctaattttttttgtatttttagtagagacgcggtttcatcatgttggtgaggctggactcgatctcctgatcttgggatccacccgccttggcttcccaaaatgctgggattacaggcatgaaccaccacacccagccaccttttttttttttttctttttctttttgaagacagaatcttgctctgttgcccaagctggagtgcagtggcgcaatctcagctcaatgtagcccccacctcctgggttcaagtgagtctcctgcctcaggctcccgagcagctgggattacaggcatccgccatcacacctggctaatttttgtatttttagtacagacgaggtttcaccatgttggtcaggctggtctcgaactcctgacctcaagtgatccgcccgcctcagcctctcaaagtgctaggattactggtgtgagccactgcgcctggcccatataacctttttaaaaaataacagctttattggaatataaaacatacaccattaagtttaccctttcaaagtgtacagtttggtgggtttggtttttagttgattcacaaagttcatctgtcaccactatgtaattccaaaatattttcaccccaggaagaaactctatactaattggcagccactccctgtcccctccctactccccaagtccctggcaaccactaatctaattattgtctccatggatttgcctattctggacagaccacatgtaaagtttttgcttaatctgattaattgataggttccacttttacagataaatagcttttcatgtcagcaaaaatgaaagatttaaaatgtagtactaggctggtcacagtggctcacgcctgtaatcctaacactttgggaggccaagctaggtggatcacttgagctcaggcattcaacaccagcttgagcaacatggcaaaacccggtctctacaacaaatacaaaaaattagccgggtgtggtggtgcatgcctgtgctctcagctcccagctacttgggaagctgaggtgggaggatcacttgaccctgggaggcagagattgcagtgagccaagatcacactactgcattccagcctgggcaacagagtgagaccccatctcaaaaaaaaaaaaaatatatatatatatatatgtagtacctgacctcccccaaagttatttgaggttcaaatgatttatttcagcctccacttaactagagctgacctcttattagacaccttggggacattactatgagccttaaagaaataaaaagtattataaaggaatacaataaatagttgtatgccaattaattaaacaacttagaaaaatggacaaagtcctagaaaaacaagaaaaacctaccaaatttcaggaagaaatggaaattctgaatagacatataacaagtaaatagattgaagtagtaataaaaaacttcccacaggttggcgtggtggctcatgcctgtaatcccagcactttgggaggccgaggtgggcagaccacgaggtcaagagatcaagactatcctggctaacaccgtaaaaccccgtctctactaaaaaaaaattagccaggcattgtggtgggtgcctgtagtcccagctacatgggaagctgaggcaggagaatggtgtgaacccaggaggtggagcttgcagtgagatgagatcgtgccactgcactccagcctgggcaacagagcgagactccctctcgagagaaaaaacaaaaacaaaaacaaaaacttccacaaaggctcatgcccacagggcttcactgctgtatttaactaaacatttagagaaaaattaataccagtttttcataaactctttcaaaaaatagaagaagaggcaacatttcccaactctttttatgaggccagtattaccctgatgccaaagccagacataagaaaggaaactacagatcagtatttcttattaatatagaggcaaaaatcttcaaataccagcagacagaatccagcaccacatcaaaaggacagtacaccatgatcaagtgcgaatgatcccaggaatgcaaggctggttcaatatctgaaaatacattaacttaatacaccataattttagaataaatggaaaaaagcaattaatcatctcaataaatgcagaaaaaaactttgacaaaattcaacattctttcgtaagaaaaaaaccatgcaacaaactacaagtaaaagacaacttcctctacctgataaagagcatctgtgaaaaacccacagctgacatcatacttaatggtgaaagttcctgacagatcaaaataagacaaggaagtccgctcttaccacttttattctgtattgtactggagattctagccaggaaaattaagcaagaaagtgaaataaaaggcatctagattggaaagaaagaagtgaaactatctatagattacatgatcttgtatatagaaaatatacaagatccaaggccgggcgtggtggcttatgcctgtaatgccagcatttgggaggccaaagtgggcagatcatttgagatcagcagtttgagaccagcctggcaaacatggtgaaactccgtctctactaaaaatacaaaaaattagctgggcatggtggtgcacacctgtaatcccagctactcagagtctgaggcaggagaatcccttgaagctggtaggcagagtttgcagtgagctgagatcgtgccactgcactccagcctgggtgacagagtcagactctgtctcaaacaaaacaaaacaaaaacaaaaaaagaaaatatataagatcctgtaaatcctaaggaacccactaaaaaatcagaactttaatcgccagggaaatgcaaatcaaaacctctgaagaaaaaacacaaactgttttttttcttggctctcacaccacagtaacaatcactacagaagtcttctgtgaccgggctgggtgcggtggctcacatctgtaatcccagcactttgggaggccaaggtgggtggatcacgaggtcaggagttcaagaacagcctgaccaacgtggtgaaaacctatctctactaaaaacacaaaaagaatagccaggtgtggtggcaggcacctgtaatcccagctactggggaggctgaggcaggagaaatgcttgaaccagggaagcagaggttgcagtgagcagagatcacaccactgaactccagcctgggcaacagagtgagacttggtctcaaaaaaaaaagaaaagaaaaggaaaagaaaaaagaaaaaaaaaagaagtcttctgtgaccaaatgttggggggaactcctgccaacaccaagcaaacaaccaattctccaatggacaattctgaattgagtgtcctccaattcaattccaacactatctacctgaagatagcatcagatcccacaagttgagggttcaatcccacaagactgcacccctacacacaccagaacttctgaccgactggcttcaaattggggtttccatgattccctcttttttttttttttttttttttttttttgagacagagtctcctctgccacccatgctggagtgcagtggcagagatctcagctcactgcaagctccgcctcccaggttcatgccgttctcctgcctcagcctcctgagtagctgggactacaggtgcatgccacaacgcccagctaattttttgtatttttagtagagatggggtttcactgtgttagccagagatggtttcgatctcctgacctcgtgatccgtccgcctcggccttccaaagtgctggggttacaggcatgagccaccatgtctggcacagctctctctttagtgagagtggggacttctgagaggaaaagaccagcaggtgggggatgtgccatattttatagtcagatttgaggatgtggtgcctgatttacataggactcacagattggtttgatcaagagtgatattacatagcatgcagggaaggctggctgcctcaccctaatcatattatgcaaatgaactttccccttggccttcgccatcttgtctgctctttactgtacacgtggctgacaaagagaagggaagatggagccaccatcttgaacatgattggcacaactgccaacatctatgtctgcagctcgattttacaggctactcttcgttagaaaggaaaataatttggggctgcttttcattaaaaggagaaccttaccaaagacttctgtacccttactatctgcctaagtaatttcttcttaactcctgtatgacctccacatggtcagctatccggaagctccctaagccctgtccttttggccttttatggagacttaattggataggcatgactcaagcatggacaaatgtgtagaaaggtgattggtcaaaaagggcacgatctaatactaataccctgaatggggaaccccagcaaggcccttgtgttcagcaactccttggcctctctgtgcagctttccttcctccagggtatgggcaggagtcctaccgaaatgaaggtgtcatcaactacactcagacaaggtatgtcagagagtttctttatggccaatttcaatacagaaaggtaggggaagattcctgccttggtgagaaaaagaagcaggtgaaaggagagcaggagaaggtcaaacagagagagagagtttttttttttttttttgagacggattcttgctctgttgctcaggctagagtgcagtgatctccgctcacactaacctccgcctcccaggttcaagcgattctcctgcttcagcctcctaactgggactacaggcgcccgccaccacacctggctaatttttgtatttgtagtaaagacggggtttcaccatgttggccaggctggtcttgaactcccgacctcgtgattcacccaccttggcctcccaaagagctgggattacaggcatgagccaccacacccagccaagagattcttttttcaatgaggcctgcttcagaggattgcagcactccagcattctagcaagagctatgggagctgtgaaccaggaactgtggacaaaatctagatgtatatatatatatatcaccaaatcacaatgaggtgctgcctcatacctgttacgatggccactatagaaaacaaaaacaaaaaacaccaaaaccagaaaatacgtgtggcaagaatgagagcgaattggaaaccccgtgcactgttggtgggaatgtaaaatggtacagctaatgtggaaaactgtgtgaaagttcctcaaaatattaaaaatagaactaccatatgatccagcagtcccacttttgggtatttatttatttatttatttatttatttatttatttatttttgagacggagcttcgctcttgtcacccagaatggagtacaatggtgcgatcttggctcacaggaacctccgcctcctgggttcatgcgattcttgtgccttggtctctcaagcagctgggactacaggggtgtgctatcacgtccagctaatttgtgtgtgtgtgtgtgtgtgtgtgtgtgtctgtgtatgttttttgagacagagtctcactctgtcgcccaggctggagtgcagtggtgtgatcttggctcattacaacctccatcttccgggttcaagtgattctcctgcctcagcctcctgagtagctgggattacaggcatctgccaccatgcagactaatttttatatttttagtagagacggggtttcaccatgttggccaagctggtctcaaactcctgacctcaggtcatccacccacctcagcctcccaaagtgctgggattacaggcatgagccatgtgcccggcctaatttttgtgttttcagtagagacagggtttcaccatgtcagccaggctggtcttgaactcctgacctcaagtgatccacacacctcagcctcccaaagtgctgggattacaggcatgagccacgtgcccggcctaatttttgtgttttcagtagagacagggtttcaccatgtcagccaggctggtcttgaactcctgacctcaagtgatccacccacctcggcctcccaaagtgctggaattacaggtgtgagccactgcgcctggccacttctgggtatttatccaaaagaattgaaatcagaatctcaaagagatatctgcattcccatgttcatttcagtattatttacaataatcaagaggtgtacacaacctaaatgtccactaacagatgaatggataaagaaaatgtgaggccaaggtgggcggatcacgaggtcaggagattgagaccatcctggctaacacggtgaaaccccatctctactaaaaatacaaaaaattagccaggtgtggtggcgggcgcctgtagtcccagctactcaggaggctgaggcaggagaatggcgtgaacccgggaggtggagcttgcagtgagctgagattgcgccactgcgctccagcctgggtgatggagcaagattccatctcaaaaaaaaagaaagaaagaaagaaagaaaatgtggcacagacatacaatggaatattattcagctgtaaaaaggaggaaatcttgtcatatgctacaacacagatgaaccctgaagactgatacagtttcgatgtgtgtctctgcccaaatctcttgtagaaatgcaatccccaatgttggaggtggggcctgtggggaagtgtttggatcacgggggcagatccctcataaatggcttgcgccatctccttagcaataagtgagcccttactctgagttcacacgagatctgactctttaaaagttagtggcacccctcctcaccctctcgctgtcttgctcctgttttcgccatgacatgcctgctccccattcgccttctgccatgattttaagtttcctggggcctccccagaagccaagcagatgccagcaccatgcttcctgtacagcctgcagaaccatgagccaattaaacctcttttcaccgtaaattacccagtctccggcatttctttatagcaaagcaagaatggcttaagacaaagacattatactaagtgaaataaaccagttatagaaggacaaaaactgcatgattccactcatacgaggtatctaaagtagtcaaactcaccaaaacaaaaattagaaaggtgatgttcagcagctgaggggagggggagaggaggagttgctgtttattgggtatcgagtttcagtcatgcaaaatgaaaaattttagaatctgctgcactacgttgtgatcgtagtttaaagtactgtacacttaaaacttgctcgggtccaggtgtggtagctcatgcctgtaatcccagcacgttaggaggccgaggcgggcggatcacgaggtcaggagatcgagaccatcctggccaacatggcaaaaccccgtctctactaaaaaataaataaataaaaattagctggggatggttgcgtggcatggaggctgaggcaggagaattgccggaacccgggaggcagaggccacagtgagccaagatcgtgccactgccccctagcctgggcgacagagtaagactccatcaaaagcaaacaaacaaacaaaaatcaacaacaaaaacttgctaggagggtacatctcatgttatatgttttatcacaataagaaaataaaactggccaggcacagtggctcacacctgtaatcccagcactttgggaggctgagatggaaggatctcttgagcccaggagtacgagaccatcctgggcaacaccgtgaaacccccgtctcgacaaaaataaacaaaatcagctgggcatggtggtgcatgcatgtggtctcagctatttgggaggctgaagagagagaattacttgagcctgggaggttgaggctgcagtaagccaagatcgcaccactgtactcctgcctgggcaatagagatagacactgtctaaaaaaaaaaaaaaaaaaaggccaaggtcaggtgaggtggctcatgcctgtaatcctagcactttgagaggccaaggtgggtgggtcacctgaggtcaggagatggaggccagcttggccaacatggtgaaactccatctctactaaaaaaatacaaaaatgagctaggcgtggtggcacgcacctataatcccagctactgaggaggctgaggcaggagaattgcttgaacatggggtgcggaggttgcagtgagccgacatcatgccacttcactccagcctgtgtgacagagcgagactccatctgaaaaacaaaaaacaaaaaacaaactaattaatgaaaacagtaatgttgcaagatataggtcaatatgcaaaaaaaaaatcaattatatttccatataattgcaatggacaggtcaggcacgtttgctcacagctgtaatcccagcactttgggaggccaaggcgggcagatcacttgaggtcaggagttcgagaccagcctggccaacatgatgaaatcccatctctactaataatacaaaaacaaacaaacaaaaaaattagccaggcatggtggtcggcacctgcaatcccaactactagagaggctgaggcaggagaatagcttgaatctgagaggtggaggttgtggtgagccgagaatgcaccattgcactccagcctgggcgacaagagtgacatttcatctcaaaaaaaaaaaaaaaaaaaaaagccgggtgtggtggctcatgcctgtaatcccagaactttgggaggctgaggtgggtggatcacgaggtcaggagatagagaccatcctggccaacatggtgaaaccccgtctctactaaaaatacaaaaaaattagctgggtgtggtggcgcatgcctgtaatcccagctactcaggaggctgaggcaggagaatcgcttgaaccagggagttggaggttgcaatgagctgagatcgtgccactgcactccagcctggtgacagagcgagaccccgtctcaaaaaaaaaaaaaaaaatgcaatgaacaatttctgaaaacgaaattaagaaaacaattccatttacaatagcacccccaaaataaaatacttaagaataaacttaacaaaaggagtacaaaatgtatgctctgaaaccttgaaataattgttgaaacaaatcaaagaagatttgatttctaagtaaatggaaagataccccacattcatggatcagaagatttaatattgttaaattaatctacccaatccctattggaattccagtgacttccttgtagaaattgacaaatgggtcctaaaattcatatggaaactcaggggactcagaatagccaaaacaatcttgaaaaagaaacaagttgaaggctcacacttcccaatttcaaaacttactacaaagctacagtaatcaagacactgtgatactgtcatagggctagacccatagatcaatgatctatagagtccatggctggatgtggtggctcacagctataatcccagcactttgggaggctgaggtgggtggatcacttgaggtcaggagttcgagaccagcctggccaacatggtgaaaccccatctctactaaaaatacaaaaattagccaggtgtggaggtgggcacctgtagtcccagctacatgggaggctgaggcaggagaatcacttgaaccctgagtgacagactctgcctcaaaaaaaaaaaaatctagagtccagaaataaacctatatgtctgtggtcaatttattttaaataagggtgccaagacaattcaatgagggaaagaatagtctttaaataaacagtgctatgtaacagtgaacatgtacaaaacatacacatacaaaataatgaacttgactgggcatggttgctcatgcctgtaatcccagcactttgggagcccgaggtgggtggatcacttgaccccaggagtttgagactagcctgaacaacatagtgaaactcctgtcccacaaaaaatacaaaaagataagcaaggcatggtggtgtgtgcctgtagtcccaactacttaggagactgaggtgggaggatcacctgagcccaagagttcaaggctgcagtgagttgtgatcacaccactgcactccagcctgggcagcagagtaagatcctgtttcaaaaaataataaataaataaggaatgtggagcccctgcctcataccatatacaaaaattaactcaaaatagggttgttgttgttttaaaaccaaatgtaaaagctaaaactataaaactcttagaagaaaacatagggacaagtctttgtagcttcaaatttggcagtgtcttttttttttttttttgagacggagtcttgctctgttgcccaggctggagtgcagcagcacaatctcggttcactgcaagctcggcctcccaggttcacaccattctcctgcctcagcctcccgagtagctgggactacaggcgcccaccaccacacccggctaattttttgtgtatttagtagaaacggggtttcaccatgttagccaggatgttctccatctcctgacgttgtgatccgggtgcctcggcctcccaaagtgctgggattacaggcatgagccaccgcacccatcccggcagtgtcttcttagacatgtcaacaaaaaggaaagcaacaacaatgaaaacagatacattgggcttcatcaaaatgtgaaacttataacatacactggggcctgtcggggggtcgggggagcaagagcattaggataaagctaatgtattcagggcttaatacataagtgatgggttgataggtgcagcaaagcaccatggcacacgtttacctatgtaacaaacctgtacatcctgcacgtgtatcccaggatttaaaataaaatatagaaaatactcaacaatcataataagtgtaaaagaattttggtcgggcgcagtggctcacgcctgtaatcccagcactttgggaggccaaggcaggtggatcacgaggtcaggagatccagaccatcctgactaacacggcaaaaccctgtctctactaaaaatacaaaaataaaataaaataaaataaaaataaataaaaataaaaattagcggggtgtggtggctggtgcctgtagtcccagctactcaggaggctgaggcaggagaatggtgtgaacccaggaggcggagcttgcagtgagccgagatcgtgccactgcattccagactgggggacagagtgagactctgtctcaaaaaaaaaaaaaaaaaaaagaatttgaaacaaaaacgtgaaacttctgtgattcaaagaacaccgtcaagaaagtgaaaaaacgcctgcctgcccgcctttctttctctctctctctctctttctttctttcaacagtctccctctgttgccgaggctggactatactgccgtgatctcggctcgctgcaacctccctgcctcaggctcctgtgattctcctgcctcggcctgccgagtgcctgggattgcaggcatgcgccgccacgcctgactggtttttgtatttttggtggagacggggtttcgccgtgttggccgggctggtctccagctcctgaccttgagtgatctgcccgtctcagcctcctgaggtgctgggattgcagacggagtctcgctcactcaatgctcaatgttgcccaggctggagtgcagtggcgtgatctcggctcgctaaaacctccacctcccagccgcctgccttggcctcctaaagtgctaagattacagcctctgcccggccgccaccccgtctgggaagtgaggagcgcttctgcccggccgccaccccgtctgtgctgggtgtggtggtgggcgcctgtagtcccagctttttggaaggctgaggcaggagaatcgcttgaacccaggaggcggaggttgctgtgagctgagattacaccactgcactccagcctgggcgacagagcaagactccatcttaaaaaaaaaaaaaggccgggcacagtggctcacgcctctaatcccagcactttgggaggacaaggcaggtggatcacgaggtcaggagattgagatcatcctggctaacacgatgaaaccccgtctctactaaaaatacaaaaaattagccgggcctggtggcaggcacctgtagtaccagctacttgggaggctgaggcaggagaatgacgtgaacctgggaggcggagctggaagtgagccaagatcgtgccactgcactccagcctgggcgacaaagcgaaactccatctcagaaaaaaaaaaaaaaaagtaagaaaagaaaaaaagaaatgtaaaatagtaaacagaaatatctcccagctcttaaaattaggcaattctgttggaaaggacataactctgaatagaggttataaggaagagtttggatttaacaggagagtgccaagaagctcttccagtttacaaagcaggagagtatcattaagcctgtgttttagaagatgactgcattctgtgattctgaaatagctatatataggttgctcgtgaaatctgtgctgctagtcttcttttttttttttttgagacagaatcttgctctgtcccccaagctggagtgcagtggcacgatctcagctcactgcaacctccgcttcctgggttcaagcaattctcctgtcttggtctcctgagtagctgggattacaggagtgcaccaccacgcccagctaatttttgtatttttaatagagaaagggtttccctgtgttgaccaggctggtcttaaactcctgacctcaggtgatctgcccgcctcggccttccaaagtgctgggattacaggcgtgagccactgtgcccggcgtcgctagtcttctcttactgaagtgaaactcacctctattctttttttttttctttttctgtttttgagacagagtctcagtctgtcacccaggctggagtgcagtagctcgatctcggctcactgcagccttcacctcctgggttcaagtgattctcctgcctcagcctcccaagtagctgggattataggagtgcatcaccacgcccagataattttttttttgtatttttagtacaggtggggtttcaccatgttggccaggctggttttgaactcctgacctcaaatgatccaccggcctcggcctcccaaagtgctgggattacaggtgtgagccatagtacccagccagaaataaatttattgactgatataaattaaaattcctgtgtatagctggcttcaggaaagcctgaataggtgttcaaagaatgtcatcaggaacttgtctcaccaatcccttacctgtgttagcttcaattaaaaaaacatatttttgggccgggcgcagtggctcacacctgtaatcctagcactttaggaggccgaggtgggtggatcacctgagatcaggagtttgagaccagcctggccaacatgatgaaaccgtctctactaaaaacataaaaattatcgggcgtggtggtgcataaccgggcatggtggtgcatgcctgtaatctcagctactcgggaagccgagggagaattgcttgcatctgggaggcagaggttgcagtgagctgagatcgcaacattgcattccagcctgggcaacaagagtgagactccatctcaaaaaaaaaccaaaaaacaaaaacaaaaaacatttttttaagagacagtttcactctgtcgcccagagctgggtccagtagtgcaatcacagctcactctaacctcaaagtcctggactcaggcattcctcctgtcccagcctcccgagtcactgagactataggcaagcaccagcacgcctggttactttttttttttgaaacagggtctccctctgttgcctatggtggtatgcagtggtgcaatcatggttcattagagcctcaatctccgaggctcgagcaattttcccgtgtcagcctccaaagtagttgggactacaggtaagtgccacaatgtccagctaatttttttttctttttattgagacggagtctcgctctgttgcccaggctggagtgcagtggtgcaatctcggctacaacctccgcctcccgggttcaagcgattctcctgccttagcctccgaagtagctgggactacatgcgcgtgccaccacgcccggctaattttttgtatttttattagagacggggtttcaccgtgttagccaggatggtctcgatctcctgacctcatgatccacctgcctcggcctcccaaagtgctgggattacaggcatgagcctccatgcctggcctgtccagctaatttttaaattttttgttttagggatgaggtcttgctatgttgcccaggctggtcttgaaatcctggcctcaagtgattctcccctggcctcccaaagtgctgggattacagatgtgaaccactgcgcccggctgttagcttcattttcaggcagcctcttctttctgccattttgccgaccagagtcgaaagaaatctcatccctaaaagttcctgcaatggtgcttgggaagaatctcattggtctacagtaggtcataaattcttctgtaaactaatcaccatggggaagaggaggtaaggtatgttctgctcggccagggtaatagcagtgggaacagaggatggactggccaggaaataacatggtggaggcagagtatgcaagtgctcattgcttagcagtgttgggaaagaaagaggattttatctattgaatgccagccatgtgttggccactgtgctgggcaaatgcaactcattttgaaggccagacatggtgtggctcatacctgtaaccccagcactctgggaggctgaagcaggaggatcacttgaggccaggagtttgagaccatcctgggtgacacagtgagatctcatctacaaaaaatgaaaaattagctaggtccagtggctcgtgcctgtgggcccacctcctggggagactgtggcaggaggaggattgcttgagcctgggatgtcaaggctgcaatgaaccataatcacaccactgcaccccagccaaggcgacagagcaagatcctgtctcaaagaaacagacaacaactcagtctgtggaagagggggacatataaacaatgactatccaatgtaccagttacaatgattgaggtatacagcaagggccactaacacaaaacagaaaggaaagcatttgggcagtgactgtgggtcaggggagaggcagttcccagagaaggaaatcttgacttgagttttatttatttattttaatttttatatttttgagatggagtctcactctgtcacccaggctggagtacagtggtgcgatctcggctcgccgagccaccacacctcgccaggtttcaagggataagtaggatacatgaaagtttggtaggaaacaaagagtaagagatttcaggcccaggctgggcacggtggctcacacctgtaatcccagctctttgggaggctgaggcagatagcttgagttcaggagttcgagacaagcctgggcaacatggcaagaccctgtctctaaaaaatatataaattaaaaataaattcaggccaggcgcagtgactcacatctgtaatcccagcacttagggaggccaaggtgggtggatcatttgaggtcaggaggttgagaccagcctgaccaacgtgatgaaattctatctctaccaaaaaattaaaaaattagtcaggtgtgatggtgcatatctgtagtcccaggtacttgggtggctgaggcaggagaatcacttgaaccagggaggtggaggttgcagtgagccgagatggtgccactgcactccagcctgggtgacagagcaagactctgtctcaaaaataaataaataaattaattttaaaaaagagatttcaggcccatgtcaagggcaaagaacagagtcaaaaaagaaaaattgctggccagggcagggcctggtggctcatgcctataatcttagcagtttggtaggctgcggtgggagcatcacttgaggccaggagtttcagaccagcctgggcaacatagcaaatccctgtctctatttctttaaaaaaaaaaaaaaaaatctggccagaaaaaccacatccaaaccaaagacatatttagttttgctcgcacaacatttttagaaatttttgaattagttgccaacattgaaagatctagagctttcacataaaaatccatatttctactttatcttgaaaagccaagtttggctacacagggccagcatttcttcatggtgacaagtggctggcaccaccacagcccctccactccctgttctggttcacccgccctgcctcagatgctcatgttacctgcacagtcctctctagtgaatgaaagacggctgccaatcctttgtaaatttccacatcaaaagaagttggctgggtgtggtggctcacacctttaatcccggcactttgggaggcaaaggtggatggatcacctgagctcaggggtttgagaccagcctggccaatatggtgaaaccccatctgttgccaaaaagagtggtttgtttgtttgtttgtttatttgtgtatagacagggtctcactctattacccaggctggagtgcagtggtgtgatcatagctcactgcagacttgacctcttgggctcaagcgatcctcccacctcagcctcccaagcagctggaactataggcacacgccacctatagtctggctaatttttaaatatttttagagacaagggtcttactttgttgcccaggctggtcttgaactcctggccctaagtgatcctcctgccttggcctcccaaaatgctgggattagaggtgtgagccactgcacccagcccgctaactttttatattattcgttgagttaggatctctctgtgttgcccaggctagtcttgaactcctgggctcaagaaatcctcctgccttggcccctcaaagtgctgggattacaggtgtgagccaccacactggagccattatttattattattttgtttgtttgtttgttttgaaacagggttgcactttgttgcccaggttggagtacagcagtgtgatgttggctcactgcaacctctgcctccctggttcaagcaatcctcccacctcagcctcctgagtagctgggacaacaggtgcatgcccagctaattttgtatattttttgtagacacaaggttgcaccatattgcccaggcagttcttgaacttctgagctcaactgatccacccgccttggcctcccaaagtgctatgattataggtgtgagccactgcacctggccaaattgacaaccattttgttatttctcattattctgggattttgagcagaagcatcctgagaaaggaagcaaaaccttttagtctactgaaaggataggcctgtaattgtcacagaataacttctaccacattctatcagttaagcagtcatgggagctgggtgtggtggctcatgcctgtaatctcagcactttgggaggctgaggtgggcggatcgcctgaggtcaggagtttcagaccagcctggccaacatggtgaaaccccatctctactaaaaatacaaaaattagccagctgtggtggcgtgtgcctgtaaccccagctactcaggaggctgaggcacgagaatcgcttgaacccaagaggtggaggttgcagtgagctgagattgtgccactgcactccagcctgagtgatggaacaagactctgtttcaaataagtaagtgagtaagtaagtaagtaagtaagtaaataaataaataaaagatggatcagaagaaggtgagatggcctgcagattacttagggggttcctgcaatggtagaagcaactcaactcaggtagtgtcggtagtgatgaagagaaaaggggagattcaaggtcaagactcctcactccaggaggccctccctggggttctaatgggacatgcaggtcagaaccaggaaacacagagacaggtttgtacctcagagacaggctgagagtcatcagagtttgcaattgaagctgcctatgtggataagatagtgtggggagtttgagtgcaataagaagagatggaggtgcgggactcacgtctgtaatcccagcactttgggaggctgagatgggtgggttgcttagggccaggagtttaagaccagcctgggcaacattatgggaccccccccgcctctccaaaaaccagaagtattagccaggcatggtgttgcacgcctttagtcccagcactttgggaggctgaggcaggaggatcgcctgagcccaggactttgaggctgcagtgagctgtaattgcacccctgcactccagcctgggtgacagaacaagaccctgaatctaaataagtaactaagaggtggagtcctgggaggactctgggtgtaatgagtaaagcagaggaagagacaccccacaggggattgacagagaaagccatagagaaagatgagaacaaggggagggtgcgtcgtcgcatattcgaaaggaacatgttcaaggaggaggcatagtcagtagcattggatggacaccaaaacgtgtttgcctgatttgatgaccaggaagttactggtggccctgctgagggcaaatcttttttttttttttttttaatggagtttcgctctgtcacccaggctggagtgcaatggctcaatctcggctcactgcaacctctgtctcccgggttcaagcgattctcctgcctcagcctccccagtagctgggattacaggtgtgcgccaccacacccagctaatttttgtgtttttagtagagatggggtttcaccatgttggccagggtggtcttgaactcctgacctcaggtgatctgcctgcctcagcctcccaaagtgttgggataacaggcgtgagccaccgggcctggctggtgagggcaaatatatgtggaatggcgagggcagaagacagactcaagtaggtggaaaagtaggaaatgaggaagtggagacagtgagtgtccaccactctctcaagaaactcacatgtgaacaataggagtgaaatagggaagtggtttgaggttgccaagttgagagaggttccccctgcacacaggaacctgggtgtgttttatatcctgaaaagagagggtctgcagagagaggcctgccagtagaggagaaaagggtgaaacgatgaggtgagatcactgaagaaatgggaggaatgtgtcccaagagggatcggccttgggcccaatgagaaccattactttaaaaacatttttttagagacagggtctccttctgtcatccaggctggaatgcagtggcgcaatcatagttcactgaagcctccaactcctgggctcaagggatcctcctgcttcagcctcccgagtagttaggactacaggcacatgccatcacacgtggctaatattttattttatttatttatttatttatttgagacagagtttcgctcttgctgcccaggctggagtgcaatggtacaatctcagctcattgcaacctccgcctcccgggttcaagcaattctcctgcctcagcctcccaagtagctgggattacaggcatgcgccaccacgcctggctaattttttgtatttagtagagacagagtttcaccatgttggtcaggctgatatcgaactcctgacctcgggtgatccgcccgccttggcctcccaaagtgctgggattacaggcattagccaccgtgtccagcccatattttatattttgtagaaatggagtctcactatgttgttcaggcttgtctcaatctcctggcctcaaatgatcctcctgccttggcctccagaagtgctgggatttcaggcatgagccactgtgcccgggcaggagtgctttcagaatgtgagtcagtgctgaccctgcaggtagatggaagatcagggccacatgaggaggtgccaggctaccagagcaacctcttgccaatgaaactgttacttctttacctggagacttgtgggggctccgtgctactcactggagaaaactccttgagaaggctctgtttgaggtcccccatgctctgcccctatggaccttcccagcattctgacctttcctctcaccccaagcatctgaggccccagccttgggggacagctctccattccctaaaacgtcatgatcttttcctgccttcatctgaatggctcttctccctcctgcctctcttctttgcttggcagactcctattcaatacctagttcaggccaggagcagtggctcacgcctgtaatcccagcactctgggaggtgaggcaggcggatcacctgaggtcaggagtttgagaccagcctgggcagtatagcaagaccccatctctaaaaaaatagaaaaattagacaggtgtggtggcttgcacctggaatcccaacactttggggtgcccaggcgggcggatcacctgaggtccggagttcgagaccagcctggccaacatggtgaaacctgtctctacaaaaaatagaaaaattagacaggtgtggtggctcacacctggagtcccagcactttgagaggccgaggcatgcagatcactctgaggtcaggagttcaagaccagctcagccaacatggcaaaaccccatctctactaaaaatacaaaaattagctgggcatggtggcaggcacctataatcccagctactctggaggtggaggcaggagaattgcttgaacctgcggggaggaggttgcagtgagccgagatcgtgccactgcactccagactgggcgaaacagcaaaactccatatcaaaataaagaaatcatgtctgctatggcagacccacagtcagctgcagctctgagccaactgcaggatgaagaaccattgcctaattggaaagtgtcagcatcccagaattcaaaaaagaaatctgatgaggcttttcctgcttgatatattatatggagaatttagatcttatgttggtttgcacaagttccctgcagaaaaaaaaattgctctgtgtatatctcttggaaaataagataatactatttttcctttgcaaaggcagctataacagatgtgaagactcagtgctcggtggtgcccaggctggagtgcagtggcgtggtctcggctcgctacaaccccgtctgggaagtgaggagcgtctctgcctggccacccatcgtctgggatgtggggagcccctctgcctggctgcccagtctgggaggtgaggagcgtctccgaccggccgccatcccatctaggaggtgaggagcgcctctttccggccgccatcacatctaggaagtgaggagcgtctctgcccggccgcccatcgtctgagatgtggggagaacctctgccccgccgccccgtctgggatgtgaggagcacctctgcccggccacgaccccgtctgggaggtgaggagcatctctgccccgccgccccgtctgagaagtgaggagaccctctgcccggcaaccaccccgtctgagaagtgaggagaccctccacccggcagccgccccgtctgagaaatgaggagcctctccgcccagcagccaccccgtctgggaagtgaggagcgtctccgcccggcagccaccccgtccgggagggaggtggggggggtcagccccccgccaggccagcagccccatccgggagggaggtgggggggtcagccccacgccccgccagccgccccgtcagggagggaggtgggggggtcagccccccgccaggccagccgccccgtccgggagggaggtcggggcgtcagcctcccgcctggccagccgccccgtccgggaggtgaggggcgcctctgcctggtcacccctactgggaagtgaggagcccctctgcccggccagcggccccgtccgggagggaggtgggggggtcagccccccacccggccagccgccccgtccgggagggaggtgggggggggtcagccccccgcccggccagcggccccgtccgggagggaggtggggggggtcagccccccgcccggccagccgcccggtccgggagggaggtggggggggtcagccccccgcccggccagccgccccgtcccggagggaggtgggggggtcagccccccgcccggccagccgccccgtccgggagggaggtaggcgggtcagccccccgcccggccagccgccccgtcagggagggaggtggggggttcagccccccgccaggccagccgcccggtccgggagggaggtcggggcgtcagccccccgctcggccagccgccccgtccgggaggtgaggggcgcctctgcccggccgcccctactgggaagtggggagcccctctgccaggccagccgccccgtccgggagggaggtggcggggtcagccccccgcccggccagccgccccgtccgggagggaggtgggggggtcagccccccgcccggccagccgccccgtccgggaggtgacgggcgcctctgcccggccgcccctactgggaagtaaggagcccctctgccaggccagccgccccgtccgggagggaggtggcggggtcagccccccgcccggccagccgccccgtccgggagggaggtgggggggtcagccccccgcccggccagccgccccgtctgggaggtgaggggcgcctctgcctggccacccctactgggaagtgaggagcccctctgccaggccagccgccccatccgggagggaggtgggggggtcggccccccgccgggccagccgccccgtccgggagggaggtgggggggtcagccccccgcccggccagccgccccgtccgggaggtgacgggcgcctctgcccggccgcccctactgggaagtaaggagcccctctgccaggccagccgccccgtccgggagggaggtggcggggtcagccccccgcccggccagccgccccgtccgggagggaggttggggggtcagcccccgcccggccagcggccccgcccgggaggtgaggggcgcctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgtactaagaaaacttctgccttgggatcctgttgatctgtgaccttacccccaaccctgtgctctctgaaacatgtgctgtgtccactcagggttaaacggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcctatgaccctgccaaatccccctctgtgagaaacacccaagaattatcaataaaaaataaataaattaaaaaaaaaaaaaaaacagatgtgaaaataaatacactcaactctaatatgattatacagaagagcatgaatgcatttcaaatgttagatgttgctagtattatcaaatgatttatttttcttttcttttcttcttttcttttcttttttttttttttttgaaacagggtctctctgtcaccgaggctggggtgcagtgacacaatcatggcctaatgcaacctcgacctgctgagcttaagcaatcctcccacctcacccgcccccagagtggctgggactgcaggcacgtgccactgtgcccagttatttattttttccttttaaattttttgtagagacaaggtcctactacgttacccaggctggtctcaaactcctggactcaagcaatcctcccacctcggccttccgaagtgctaggattatgggcctgagtcaccacactcagcctcaaataatttcatattgaccttttaatcattattcctctctgccaagcactgaaaagttgaatcattatactctatttctgcagtgatatagattatgaaaattcctttcgaattcattgcagcagctaacttttttgagtcattgacttcattttatattttaaaaattatgaaataccgtctgtcattgcattctaattaaaatttgtgcagaatgctttgggaaaatggatcttttatagaaaaaaaactggaacaaatgatttcttttctttcttttttttgttttttgagatggggtcttgctctgttgcccaggctggagtgcagtggcatgatctcggctcactgcaacctccgcctcccgtgttcaagcaattctctgcttcagcctccacagtagctaggactacaggtgcccactaccatacccggctaatttttgtatttttagtagagatggggtttcaccatattagccaagctggtcttgaactcctgaccttttgatccacccaccttggcctcccaaagtgctgagattacaggcgtgagccaccacgctcggcctgggacaaatgatttctatggctttcaaagataaaatatataatatactaaatcaggggtgtccaatcttttggcttccccggaccacattggaagaagaattgtcttgggccacacataaaatatactaacgatagctaatgggctaaaaaaaaaaaatcacaaaaaaatctcataatgttttaagtttaccaatttgtgttggtctgcattcaaagccatcctggatcatcctggggttgcacaagcttgcactaaaccaactctaacatagcttattctgttttactgttaaattatatctctgggctgggcaaggtggcgcatgcctgtaatcccagcactttggaaggccaaggtgggcagatcacttgaggccaggagtttgagaccagcctggacaacatggcgaaaccccatctctactaaaaatagaaaaattggctgggcacggtggctcatgcctgtaatcccagcactctgggaggccgaggcaggcagatcatgaagtcaggagttcaagaccagcctggtcaacatggtgaaaccccatctctactaaaaatacaaaaaattagccaggtgtgggccggttgcggtggctcacacctgtaatcccagcactttgggaggccgaggcaggaggatcacaaggtcaggagatcgagaccaacctggctaacacggtgaaaccccgtgtctactaaaaatacaaaaaattagctgggtgcggtggtgggtgcctgtagtcccagctactcgggaggctgaggcaggagaatggcgtgaacctgaaagacggagcttgcagtgatcacaccactgcactccagcctgggcgacagagcgagactctgtctcaaaaaaaaaaaaaaaaaaaattagctgggtgtggtggcacacacctgtaatcccagctactccggaggctgaggcaggagaattgtttgaacccagaaggcggaggctgcagttagctgagatcatgccactgcactccagactgggcgatagagcaagactctgttttgaaaaaaaataaattagccaggagggttggtgcactcctatagtccctgctacgtgggaggctgaggcatgagaattgcttgaacccaggaagtggaggctgtagcaaactgagattgtgccactgcactccagcctgggcaacagagcgacaacccgtctgcgaaaaaaaaaaaaaaaaaaaagcttttatggatgattaaattttagtacatttccaaaaaaaaaattcttgctaaatttaggtgtaattaattatgtattacgtaatggtactgtggttaggtaaagtaatccttatctgacatacaataatatgacgaatctcaaaacattatgaaaagtgaaaaaaagcagacccgtattgtatatttcatttgtgtggaacattctagaacaggcaaaattaatctataatgacagcaaaaagatcaatcgctgtctggggctgaggttggggattgattggggaaggaacttattttttttatttttattttttttgagatggagtctcgctctgtcgcccaggctggaatgcagtggcgcgatcttggctcactgcaacgtccgcctcctgggttcaagcgattctcctgcctcagcctcctgagtagctgggaccacaggtacttgccaccacgcccggctaattttttgtatttttagtagagatggggtttcaccgtgttggccagaatagtctcaatctcctgactggcagccactgcgcctggcgagtggaaggaaattttaagggtgatgggagtatttcatattttgattatggtagtaattacatgggtatgtatatttgtcaaaactaactgaatcatgcacttaaaatgaatgtgctttattgtatgaaaattaaagtgggctgcgcgcagaggctcacgcctgtaatcctagcactttgggagcctgaggcgggtggatcacgaggtcaggagtttgagaccagtgtggccacatagtgaaaccctgtctcaactaaaaatacaaaaaattagccggctgtggtggtgtgcacctgtaatcctagctacgtgggaggctgaggtaggagaatcacgtgaacccgggaggcggaggtttcagtaagctgagatcgcactactgcactccagcctgggtgacagcgtgagactccgtctcaaaaaaaaaaaaaaaaaaaaaaaaaaagataaaaaaagaaaattaaagtgtgttttgttgtatgtaaataaagtttgttttaaaaagaaggaaaataacgttacaactagaataaaaataatccgccaggcatggtggtgcacacctgtaatcctagcactttgggaggccaaggtgggaggatcgcttgagcccaggaattcaagaccagtcttggcaaaatggtgaaaccctgtctctacagaaaatgcaaaaattagccagttgtggtgatgagcacctgtcccagctacttgggaggctgaggcaggagacttgcttgaacccaggaggaagaggttgcagtgagctgagatctcgtcactgcactggaattacaggcacacgccaccacgtccagctaatttttgtatttttgtagagacgggtttttgtgatgttggccaggctggtctcaaacttctgacctcaggtgatctgcccaccttgaccctgaaaagtgctgggattacaggtttgagccactgcatctggccagatctaagagatttttttttaagtctctgtgtgttagaggtaaatactgaagttttttttttttgtttttttgagatggagtctcactgtgtcgccagtctggagtgcagtggcatgatcttagctcactgcaacctccacctcctgtgttcaggcgattctcctgcctcagcctcccgagtagctgagactacaggtgtgcaccaccacgcccagctaatttttctgtttttagtagagatggggtttcaccatgttggccaggatggtctcaatctcttgacctagtgatctgcccacctcagcctcccaaagtgctgggattacaggtgtgagccactgtgcctggctaatactgaagtatttaagttgaaatgctatgatgtctgagatttgttttaatacattctgtttttttttgttttgttttgttttgagacggagtctcaatctgtcgcccaggctggagtgcagtggcgcaatctcagctcactgcaagctctgcctcccgagttcacgccattctcctgcctcagcctcccgagaagctgggactacaggcgcccaccacctcgcctggctaattttttgtatttttagtagaaacagggtttcaccatgttagccaggacggtctcgatctcctgaccttgtgatccgcccgcctcagcctcccaaagtgctgggattacaggcgtgagccactgcgcccggctgttttaatacactctaagaaaataatgtgaaaaaagaaatgaatcaatgtttgctaatattgccatatttgaatcaaatattgccaatatatgttgaccattgtcaaagctggatgatgggtacaaaagagtttattatacaattattcccgttttctgtatttgaaaatgtctacaggccgggcatggtggcacatgcctgtaatcccagcactttgggagcctgaggcaggaggatcacttgaggtcaggagttggagaccagcctggccaacatggtgaaaccccatcactactacagatacaaaattagctgggtgtggtggtgcatgcctgtaattccagctactcaggaggctgaggcaggagaatcatttgaacccaggaggtgaaggttgcagtaagctgagattgcagcattgcactccagactgggcaacagaatgagactctgtctcaaaaaaaattggctgcatgaggtggctcatgccagtagtcccggcactttaggagcccaaggtagaggattgcttgagcctaggaggtcgagtccacagtgagctctaatcgagccactgcactccagcctgggtgatagagtgagaccctgattcaaaaaataaaaataaagttaacaaattcttgaaaacagataaaataggctgggcgcagtggctcacgcctgtaatcctagcattttgggaggccagggcaggcagatcacctgaggtcaggagtttgagaccagcctggccaacatggtgaagccccatctccactaaaaatagaaacaaattagctgggcatggtggtgaacatctgtaatcccagctactcaggaggctgaggcaggagagtcgcctcaacctgggaggcagaggttggagtgaaccaagattgtgccattgcactcctgcctgaacaacagagtgaaactccatctcaaaaataataataataataataataagagataaatccttattaccatcaaaagttaaaaaagaagaaagaagggccgggagcagtggctcacgcctgtaatcccagcattttgggaggccgaggcggacggatcatgaggtcaggagatcaagaccatcctggctaacagggtgaaaccccgtctctactaaaaatacaaaaaaattagccgggtatggtggcgagcacctgtagtcccagctacttgggaggctgaggcaggagaatggcgtgaacccaggaggtggagcttgcagtgagctgagatggcaccactgcactccagcctgggcaacagagcgagactctgtctcaaaaaaaaaaaagaagaagaagaagaaggaaacctagttcaaattttgataaggaaaaaaaaaaagagagaatttgttgcttcacataatggaaaggatctagcttcaagtgcggctggacccagggcgggctccgggagtctgtcttgttctctccctttcttgaccctactgtcctctaggttggttctgttctcaggcagttttgcttcagatgaaggtgggatgactaccagcatttcttagacttctatcctataatgtgagtcatccaacagaaagttccaataaaaggcctgcaattagcactttgggaggccgaggtgggcggatcacctgaggtcaggagtcccaaaccagcctgaccaacatggtgaaaccccgtctctactaaaaaaatatggaagtagccaggcttggtggtgcatgcctgtaatcccagctcctcaggaggctgaggcaaggagaatcgcttgaacctggaaggtggaagttgcagtgagccgtgattgcgccattgcactccagcctgagcaacaagagcaaaactctgtctcaaaaaaaaaaaaaaaaaaaaaggcctggaattagttcgcagggcactgttggcctggcctgggtctccagcgctcatcactcctctcttaatcagctgttctctaatggcaggagtgtgctaattagcctctgaatccccagcacaaagcaccctgcctgggacacaagtaggtgggtggatggatggacagatgggtgaggaagaggatagaaaataagcaacacagtgagaccatgtctctaaaaaaattaaaagagggctgggtgaggtggctcaggcctataatcccagcactttgggaaaagctgaagcgggagaattgcttgcattcaggagttcaagaccaacctgggcaataatgcaaaacccccatctccacaaaaaatttaaaaattagctgggtattatggcacttgcctgtagtcccagtgactcgagaggctgaggtgggaggatcgctcacttgagcctgggaggtggaggctgcagtgagctgtgattgtgccactgcacgccagcctgggcgacagagtgagacgctgtctcaaaaataaattaattaaattaaataaaaaataagaaaaagagctgggcacggtggctcacgcctgtaatttcagcactttggtaggccaagatgagcagatcgcctgaggtcaggagtttgagaccagcctggacaacatggtgaaatcccatgtctactaaaaattcaaaaaatttggccgggcgtggtggctcacgcctgtaatcccagcactttgggaggccgaggcgggtggatcatgaggtcaggagatcgagaccatcttggctaacacagtgaaaccccgtctctactaaaaatacaaaaaattagccgggagcggtggcaggctcctgtagtcccagctacttgagaggctgaggcaggagaatggcgtgaacccaggaggcggagcttgcagtgagccgagatcgcgccactgcactccagcctgggcgacagagccagacgctgtctcaaaaaaaaaaaaaaaaaaaaaaaaaaaaaaattcaaaaaattagccgggcgtggtggcgggcacctgtaatccctgctacttgggagcctgaggcaggagaatcgcttgaacctgggaggtggaggttgcagtgagccaaggtcgggttactgcactccagcctgggcgacagtgtaagactctgtctcaaaaaaaataaaaaataaaaaataagaaaaataagaaaagggtccctttcacatgtttacaaagcatgctaccatgctaagggcagaaactccaagtggaagtgacttcccaaagacagcatgttacgtgtgtcattctagggccacactttctccatggagaaggcggagggggtagggaaagttgccagcacactccagcctggttcctggcactgtgcccagcatttatagctagtttccattagtcctcatcctctataaagtgagggccactgtgcacctgtcctagatgaggaaaacgcacctggccagggacagtaaggagatgctgaaaccaaggttatcaggggtgcctgaccccaccatgctccacagcctcctttgggcaagacagactagggaagctctgtgaaccttgctaaagacattggactttggccgggcatggtggttcacgcttgtaatcccagcactttgggaggcccaggtgggtagatcacctgaggtcagaagttcaagaccagcctggccaacatggtgaaaccccctctctactaaaaatacaaaaatttgccaggcaaggtggcatgcaccgtaatcccagctactcgggaggctgagtcaggagaatcgcttgaacctaggaggcgcaggtcacagtgagcagagattgtaccactgtactcaagcctgggtgacagtgagactctgtctcaaaaaaaaaaaaaataaataaataataaaaataaaaagaggagtaatgatttgattccaacacttcagtctacctctactgtaggtatctggctccttggaagggcctctggtcctgtctccctccagggtaggtgtaatcagaactttttcagctgcaagtgccaggaatccaactcatacttcttggcttacgtgaaaaagaagtgcattgccttatacaacaggaaagttaagggtttcaggcacagcttgatccagacactcaaatgatctcaagaatatgtctcttcatatctggcctcttcaggcctctgtgtagacccatcctagccagctttttgctgttttttttgtttttgttttttgtttttttttttttgagacagagtcttgctctgtcgtccaggctggcgtgatctcgggttaccaaaactcccacctcctcagttcaaactattctcctgcctcagcttcccaagcaactgagactacaggtgcacaccaccatgcctggctactttttatatttttagtggagacaggttttgccatgttggccaggctggtctcaaactcctggcctcaggtgatctgcctgcctcggcctcccaaagtgctgggattacaggcgtgagccactgcaccttgctctgaccagcttttcctgcataccaacaagatatcaccagcagtgctgggcttacatcctatcagcttcctaactcccagtggagagagggcatctttttcacagcagctccaaggtgagtcttgggcacaagatgaatcaagtgcccatccctgagccaatgaaaacaggttgctttggttgggaagcacaggccatgtgaatacgccaggtcccctcctgaacctcatggagtgcctgtgaggagaggttggttccccaaaagaaaatccaataaagaggcgacgggaccaggcacggtggctcatgcctgtaattgcaccactttgggaggctgaggcaggaggattgcttgagcccaggaggtcgagacccacctaggccacatagtgagatcccgtctctaccaacaatttaaaaaattagctaggtgtgttgggcatgtgcctctggtcccaggtactcgggaggctctgaggatggatgggaggatcgcttgagcgtgggaggttgaggctgcagtgagctgtgatcgtgccattgcaccccagccagagggagaccctgtctcaaaaaaaaaaaaaaaaaaaaaaagagagaggcaatggtaagagctaaaccagcaggaacaagagaggcaaaggtcccccttttttttcttttaattgaaactgggtctccctctgtcacccaggctggagtgcagtggtgcaatcatagctcactgttagcctggaactcctgggctcaagcgaacctcccacttcagcctcctaagcagctgagaacacaggcacatgccaccacagctggctaatttcattttttttttttttaagagatggggtcttgctatgctgcccacactggtctcaaactcctaggctcaagtgattctcgccgctcctgggcaaatgccctctgacatccc

SEQ ID NO: 492 - DNA, 1320 bp, Homo sapiens
gcatctcattttttgatccaactcaaaaaagagtaataaggatgtagaataaccaaaggtaattatgtccatttagaacaagtactttaaaaaagaaattcaaggaagtaaactaattaattaaatgtatacttcttataccctaatgatctaacgagttaatacagtagtagttatgccttgggttataaaaaactttttttaattttaattttaattaaatttttttgagacggagtctcgctctgtcgcccaggctggagtgcagtggcacgatctgggctcactgcaacctttgcctcctggattcaaatgattttcctgcctcagcctcccgagtagctgggattataggcatgtgccaccatgcccggctattttgtatttttagtagagacagaatttcgccaagttggccagactggtctcaaactcctgacctcatgatccacgcacctcagcctcccaaagtgctggaattacaggcttgagccaccgcgcctggcctatttttattttttattattttttaatttaatagagatggggtttcgccatgttggccaggctggtcttgaactcctgggctcaagttatgtgcctgcctcagcctcccaaagtgctgggattacaggcatgagccactgtgcctggccctaaaaagctttatcttacaagatatttcaagtttattatttctttttgtttgtttttgagatggagtcttgctctgtcgtccaggctggagtgcagtgatgccatcttggctcactgcaacctccacctcctgggttcaaatgattctcctgcctcagcctcctaagtagctgggactaaaggtatgtgtcactacacctggctaatttttttgtatttttagtagagacagggtttcaccatattggccacgttgatctcgaactcctggcctcaagtgatgcacccgcctcagcctcccaaagtgttgggattacaggtgtgagtcaccgtgcccagtctcatgtttattatttcatgtgaacttgaaacatccttgtgaggtggcaagtacacattatcatattcagttaagaaaaagagaaacagaaaggttatttgacttgtactttatcacttatagctggttagtggtgacaaccgaacttgaacttgggacttctgagtccgaggtactttctgctacataaacccaagctgcctgccagactgtaactctaacagcttagtgtgttattagctattttgagacacatatttgctggggggtactagttaatcaaaatttaactgacacactgtgtaagactccagagacccagc

SEQ ID NO: 493 - DNA, 12390 bp, Homo sapiens
acacagttgtaacttagaatatgcttataatatttttaaaaatgttatagcatccttttaaagagtttatgaataatttgtgctggttttcaaggggaatgcttccagcttttgctcattcagtatgatattggctgtgggtttgtcacaaataggtcttattattttgagatatgtctcatcaatacctagtttattgagaatttttagcatgaagagatgttgaattttatcgaaagacttttctgcatctattgagataatcatgtggtttttctcactggttctgtttatgtgatggattacatttattgatttgcatatgttgaacgggccttgcatcccagggatgaagccaacttgatcatggtggataagctttttgatgtgctgctggattcggtttgccagtcttttattgaggattttgcattgatgttcctcagtgataatgacctgaaattttctttttttgttgtgtctctgccagattttggtatcaggatgatgctggcctcataaaatgagttacggaggattccctcttttctatcatttggaatagtttcagaaggaatggtaccagatcctctttgtacctctagtagaattcggctatgaatccctctggtccttttcttggttgctaggctattaattattgcctcaatttcagagcctgttattggtctattcaggaattcaacttcttcctggtttagtcttgggagggtgtatgtgtccaggaatttatccatttcttctagattttctagtttatttgcgtagaggtgtttataacactctctgacggtagtttggatttctgtgggatcagtgctgatctcccttttatcattttttattgtgtctatttgattcttctctcttttcttctttattagtcaggctagtggtctatctattttgttgatcttttccaaaacaccagctcctggattcattgattttttttgaagggttttttgtgtctcttgtcgccttcagttctgctctgatcttagttatttcttgtcttctgctagcttttgaatttgtttgccattgcttctctagttcttctaattgtgatgttagggtgtcgattttagatctttcccccttcctcctgtgggcatttggtgaaacactgctttagctgtgtcccagagattctggtatattgtgtctttgttctctttggtttcaaagaactaatttatttctgccttaattgtgttatttacccagtagtcattcaggagcaggttgttcagtttccatgtagttgtgcggtttgtagttagtttctcaatgctgacttctaatttgattccactgtggtctgaggggctgtttgttatgatttccattcttttgagtttgctgaggagtgttttacttccaattatgtggtcaattttagaataagtgcgatgtggtgctgagaagaatgtatattctgttgatttggggtggagagttctgtagatgtctattaggtccgcttggtccagagctgagttcaactcttgaatatccctttttttttttctgaatatcctttttaattttcagtctcgttgatctaatattgacagtgaggtgttaaagtctcccactgttattgtgtggaaatctaagtctctttgtaggtctctaagaacttgctttacgaatctgggtgctcctgtattgggtgcatatatatttaggacagttagctcttcttgctgcattgatccctttatcattatgtaatgccttgtttttttttttatctttgttggtttaaaatctgttttatcagtgatgaaaattgcaactcctgcttttttttttctttccatttgcttggtaaatcatcctccatccctttatttcaaacttatgtgtgtcttgcatgtgagatgggtctcctgaatacagcacactgataggtcttgcctctttatccaatttgccagtctgtgtcttttaattggggcatttagcctgtttacatttaagattaatattgttatgtgtgaattgatcctgtcattacgatgttagctggttattttgcccattagttgacgcagtttcttcatagcatcaatggtctttataatttggtatgcttttgtagtggttggtactggttgttcctttccatatttagtgctttcttcaggagctcttgtaaggcaggcctggtggtgacaaaatctctcagcatttgcttgtctgtaaaggattttctccttcgcttttgaagcttagtttggctagatatgaaattctgggttgaaaattattttctttattaatgaatataggcccccactctcttctggcttgcagggtgtctgagagagatccgctggtaagactaacagggatgggcttccctttgtgggtaacccgacctctctggctgcccttaatatattttccttcatttcagccttggtaaatctgacgattacatgtcttggggttgctcttctcggggagcatgtttgtggtgatctctgtatttcctgaattggaatgctggcctgtcttgataggttggggaagttctcctaggtaatatcctgaagagttttttccaatttggtccattctccctgtcactttcaggtacatcaatcaaacgtaggttcactcttttcacatagtcccatatttcttggaggctttgctcattcccttttgttttttttttttctctaatcttgtcttcttgctttatttcattaagttgatcttcaatctctgatatcctttcttctgattcatcgattcggctattgatactcatgtatgtgtcacgaagttctggtgctgtttttttcagctccatcaggtcatttatgttcttctctaaactggttattgtagttagcaattcctctaccctttatccaaggttattagcttccttgcattgagttagaacatgctcctttagcttggaggagtttgttattacctaccttctgaagcctacttctgtcaattcaccaaactcattctctatccagttttgttcccttgctgtcaaggagttgtgatcctttggaggaaaagaggcattctggtttttggaactttccgcatttttgcactgggttttcctcatcttcatggatttatctacctttggtctttgatgttggtgacctttggatggggtctctgagtggaagtcctttttgttggtgttgatgctattcctgtttgttagttttccttctaacagtcaggcccctctgctgctggtctgctggagttggctggaggtccactccagaccctgtttgcctgggtatcaccagcggaggctgcagaacagcaaagattgctgcctgttccttactctggaagcttcgtcccagaggggcattgccagatgccagcagagctctcctatatgaggtgtctgtcaacccctgctgggaggtgtctcccagtcaggaggcacggggttcagggaccaacttaaggaggtagtctgtcccttagcagagcttgagtgctgtgctgggagatccactgctctcttcagagccggcaggcaagaatatttaagtttgctgaagctgtgcccacagctgccccttccccaaggtcaaaaatttaaaattttaagtgactacttgaaaaataaaatatctaaatgatcagatccttattatcttcctctaagtcatctttggagatatctaacatctgtgatctgtgtaatgatttttaattctagcttataaatgacaagccaagacctttgccagtattttctttcaacttgatatttttgtcagacctctggaattatacatcatgtatctgatttaaagatttaattatcatagtttattcacctatcataattaatcatgcttagttaaaaagtctcatttcacagctacaaaaagcaaatactcatattcaaatttcactgtgcagaaacaagctaatcttttattagaaatatggctcccttccaaaaaggaaacagctttaattactaagaaactatgaagcaaatcatttggaccaacaatgactttgtttcaatgttctctcacataagccttactttattctttaaaagatgaatttagtcattagtagtacaacagggatacctgtttatgtaattaataaactaagcagatagtcccaagattaaatgttaccctgctacaatttttaacaaaagtgacggattctttcctaatatttgcctgccatttaacataaagtcataaagattttctgctcgagatgttttatgaagcacaaaacgacctcctttttaaaccaaagcaagattggctaatcaaattttttataactgcgaaacattacataacagggactgtgctttttatgtatcctttagctaacaaactgttactaaattttattacctcaaagacaactgaacacagaatggactactgcctttttgcctacacttcttacctaaaactaagcccttttgttctccaatacattaacagttcatttcaatttctggtatttgaaacgtaggtgtgatctaaagtctttgcacgtaattttaaaacaaaagcacttctgatagtttctaaacataaatgaggcaacacttcacttcttctttagttaccgctgtggcaggtcctcacctattcctgatttcaaagagtaaaactcattttctagaggagactgactctgtaaaaggttgataaatagagtatttataaatcacatgacaaaaaatgctataaactaggtacttataggttcaattatatattttttttaatttttaaacttttaggttcacgggtaacgtgaatgtttgttacacaagtaaactcatgagaacaaagttacaacacatcagaatctctgggacacagctaaggcagtgttaagagggaaattcgtagcactaaatgcctccatcaaaaagttagaaagatctcaaattaacaacttaacatcacaactgaaagaattagagcagcaataacaaatcaaccccaaactagcagaagacaagaaataaccaaaatcagagctgaactgaaggaaatcaagatatgaaaaaccattcgaaaggtcactagatccaggagttgtttttttgaaaaacttaatgagatagataggccactagctagactaactgaattatattttaaatgcactagaggagctgactttctaagaaatattatcattaactctttaatatacctgttttttaaaattcatacatttctaatagacagcagaaaataactaattagtatactgacagttgaaccttttttaatatttataattaaaaaatgaagtttattttatttttttaatatacttaaagttctagagtacatgtgcacaacgtacaggtttgttacatatgtatacatgtgccatgttggtgtgctgcacctgttaacttgtcatttatattaggtatatctcctgatgctatccctccaccctcctcctaccccatgacaggccctggtgtgtgatgttccctaccctgtttccaagtttttcattgttcaattcccacttatgagcacgaacatgcagtgttcggttatctgtccttgcgatagtttgctgagaacgatggtttccagcttcatccatgtccctacaaaggacatgaactcatcctattttatggctgcatagtattacatggtgtatatgtgccaaattttcttcacccagtctattgctgatggacatttgggctagttccatgaatatagcagcatgatttataatcctttgggtatatacccagtaatggaatggctgggtaaaatggtatttctagttctagatccttaaggaatcaccacactgtctgccacaatggttgaactagtttacagttccaccaacagtgtaaaaatgttcctatttctccacatcctctccagcacctgttgtttcctgacattttaatgttgccattctgactggtgtgagatggtttctcattgtcgttttgatttgcatttctccgatgatgagcattctttcatgtgtctgttggctgcataaatgtcttcttttgagaagtgtctgctcatatccttcgcccactttttgatggagttgtttttttcttgcaaaatttctttaagttctttatagattctggatattagccctttgtcagatgcgtagattgcaaaaattttctcccattctgtaggttgcctgttcactctgatggtagtttcttttgctatgcagaagctctttagtttaattagatcccatttgtctattttggcttttgttgccattgcttttggtattttagtcatgaagtccttgcccatgcctatgtcctgaatggtattgcctaggttttcttcttgggtttttatggttttaggtctaacatttaagtctttaatccatcttgaattaatttttgtgtaaggtgtaaggaagggatccagtttcagctttctacatatggctagccagttttcccagtaccatttactaaatacggaatgctttccccatttcttctttttgtcaggtttgtcaaagatcagatggttgtagatgtgtggtattatttctgagggctctgttctgttccattggtctatatctctgttttggtaccagtaccatgctgttttggttactgtagccttgtagtacagtttgaagtcaggtagcgtgatgcctccagctttgttctttggcttaggattgtcttggcaatgcaggctcttttttatttccatttgaactttaaagtagttttttccaattctgtgaagaaagtcattggtagcttgatgaaggtggcattgaatctataaattaccttggccagtatggccattttcatgatattgattcttcctatccacaagcatggaatgttcttccatttgtttgtgtcctcttttatttccttgagcagtggtttgcagttctccttgaagacgtccttcacatcccttgtaagttggattcctaggtattttattctctttgaagcaattgtgaatgggagttcactcatgatttagctgtttgtctgttattggtgtataggaatgcttgtgacttctgcacattgattttttgtatcctgcgactttgctgaagttgcttatcagcttaaggagattttgggctgagacgatggggttttctaaatatacaatcatgtcatctgcaaacagggacaatttgacttcctcttttcctaactgaataccctttctttctttctcctgcctgattaccctggccagaacttccaacactgttgaataggagtggtgagagagggcatccctgtcttgtgccagttttcaaagggaatgcttccagtttttgcccattcagtatgatattggctgtgggtctgtcataaatagctcttattattgcgagatacgtcccatcaatacctaatttactgagagtttttagcatgaagggctgttgaattttgtcaatggccttttctgcatctattgagataatcatgtggtttttgtctttggttctgtttatatgatgggttacgtttattgatctgtgcatgttgaaccagccttgcatcccagggatgaagcccacttgatcatggtggataagctttttcatgtgctgctggattcagtttgccagtattttattgaggatttttgcactgatgttcatcagggatatggtctaaaattctctttttttgttgtctctctgccaggctttggtatcaggatgatgctggcctcataaaatgagttagggaggattccctctttttctattgactggaatagtttcagaaggaatggtactagctcctcttcgtacctctggtagaattcagctgtgaatccatctggtcctggactttttttggttggtaggctaataattattgcctcaatttcagagcctgttattgatctattcagaaattgaacttcttcctggtttagtcttcggagggtgtatgtgtccagaaatttatccatttcttctagattttctagtttatttgcatagaggagtttatagtattgtctgatagtagtttgtatttctgtgggatcggtgttgatatcccctttatcattttttattgcatctatttgattcttctctcttttcttctttattagtcttgctagtggtgtatctattttgttgatcttttcaaaaaaccagctcctggattcaccaattttttttaagggtttttgtgtctgtacctccttcatttctgctctgttcttagttatttcttgccttctgctagcttttgaatgtgtttactcttgcttttctacttcttttaactgtgatgttagggtgtcaattttagatctttcctgctttctcctgtgggcatttagtgctataaatttccctttacacactgctttaaatgtgtcccagaaattctggtatattgtgtctttgttctcactggtttcaaagagcatctttatttctgccttcatttcgttacgtacccagtagtcattcaggagcaggttgttcagtttccatgtagttgagctgttctgagtgagtttcttaatcctgagttccagtttgattgcactgtggtttgagacacagtttatcataacttctgttctttttcatttgctgaggagtgctttaattccaactatgtggtcaattttggaataagtgtgatgtggtgctgagaagaatgtacattctgttgatttggggtggagagttctgtagatgcctattaggtccacttggtgcagagctgagttcaagtcctggatatccttgttaactttctgtctcactgatctgtctaatgttgacagtggggtgttaaagtctcccattattattgtgtggagtccaagtctctttgtaggtctctaaggacttgctttatgaatctgggtgctcctgtactgggtgcatatatatttaggatagttagctcttcttcttgaactgatccctttaccattatgtaatggccttgtctctttagatctttgttggtttaaagtctgttttatcggagagaggattgcaacccctgcctttttttgttttccatttgcttggttgatcttcctccatccctttattttgagcctatgtatgtctctgcacgtgagatgagtctcctgaatatagcacactgatgggtcttgactctttatccaacttcccagtctgtatcttttaattggagcatttagaccatttacatttaaggttaatattgttatgtgtgaattcaatcctgtcatcatgatgttagctggttattttgctcgttagttgatacagtttcttcctagcatcaatggtctttacaagttggcatgtttttgcagtggctggtaccgcttgttcctttccatgtttagtgattccttcaggagctcttgtaaggcaggcctgatggtgacaaatctctcagcatttgcttgtctgtaaaagattttatttctccttcacttatgaaacttagtttggcaggatatgaaattctgggttgaaaattcttttctttaagaatgttgagcctggctgccccgtctgggaagtgaggagcgcctctgcccgggcgccccgtctgggaagtgaggagcgcctctgcccagctgtccagtctgggaagtggggagcgcctctgcccaggcgccccgtctgggaagtgaggagcgcctctgcccagctgtcccgtctgggaagtgaggagcgcctctgcccggctgccccgtctgggatgtgaggagcgcctctgcccagccgccaccccgtctgggaagtgaggatcgcctctgcctggccgcctcgtctgggaagtgaggagcgcctctgcctggccgctgtgcaatcttccaagcatgaagtgacagcctgtctgcaggggtacccaacagctctgaagagacagcgaccatcgagaacgggccatgatgactatggcagttttgtcaaaaagaaaagggggaaatgtggggaaaagaaagagagatcagattgttactgtgtctgtgtagaaagaagtagacatagcagactccattttgttctgtactaagaaaaatttttctgccttgggatgctgttaatctataaccttacccccaaccacgtgctctctgaaacatgtgctgtgtcaactcagggttaaatggattaagggcggtgcaagatgtgctttgttaaacagatgcttgaaggcagcatgctggtcaagagtcaccaccactccctaatctcaagtacccagggacacagacactgcggaaggccacagggacctctgcctaggaaaaccagagacctttgttcaagtgtttatctgctgaccttctctccactattatcctatgaccctgccacatccccctctccgagaaacacccaagaatgatcaataaatacttcaaaaaaaaaaaaaaaagcaaatcataaaaaaaaaagaatgttgaatattggcccccactctcttctggcttatagagtttctgccgagagatccgctgttagtctgacgggcttccctttgcgtgtaacgggacctttctctctggctgcccttaatattttttctgtcatttcaactttggtgaatccgacaattatgtgccttggagttgctcttctcaaggagtatctttgtggcgttctctgtatttcctgaatttgaatgttggcctgccttgctaggttggggaagttctcctggataatatcctgaagagcgttttccaacttggttccattctccccgtcactttcaggtacaacaatcaaatgtagatttggtcttttcacatagtcccgtatttcttggaggctttgtttgtttctttttattcttttttctctaaacttctcttctcgcttcatttcattcatttgatcttcaatcactgataccctttcttccacttgatcaaatcagctactgaagcttgtgcatatgtcatgtagttcttgtgccatgattttcagctccatcaggtcatttaaggtcttctctatactgtttattctagttagccattcgtctaatctttcttcaaggtttttagcttctttgtgatgggttcgaacatcctcctttagcttggagaagtttgttattaccaatcttctgaagccttcttctctcaactcgtcaaagtcattctccgtccagctttgttccgttgctgacaaggagctgtgttcctctgcaggagaagaggtgctctgatttttagaattttcagcttttctgctctgttttttccccatctttgtggttttatctatctttggtctttgatgatggtgacgtacagatggggttttggtgtggatgtcctttctgtttgttagttttccttctaacagtcaggaccctcagctgcaggtctgctggagtttgctggaggtccactccagaccctgtttgcctgggtatcaccagcggaggctgcagaagagcaaatgttacagaacagcaaatgttgctgcctgatccttcctctggaagcttcgtctcaagaggggcacccggctgtatgaggtgtcagttggcccctactgggaagtgtctcccagttaggctactcgggggttggggacccacttgaggaggctgtctgtctgttctcagatctcaaactctgtaacgggagaaccagtactctcttcaaagctgtcagacagggacgtttaagtctacagaggtttctgctgccttttgttcagctatgccctgcccccagaagtggagtctacagaggcaggcaggcctccttcagctgtggtgggttccacccagttcgagcttcccggccgctttgattacctactcaagcctcagcaatggcggacacccctcccccagcctcgctgccaccttgcagttcgatctcagactgctgtgctagcagtgagcgaggctctataggcgtgggaccctccaagccaggcgtgggatataatctcctagtgtattgtttgctaagaccattggaaaagcacagtattagggtggaagtgtcccaattttccaggtaccatgtgtcacggcttcccttggcttggaaaaggaattccctgacctcttacgcttcctgggtgaggcgatgccccgccctgcttctgctcacagtccgtgggctgcacccactgtccgacaagccccagtgagatgaacccggtacctcagctggaaatgcaaaaatcacccgtcttctgcgtcgctcatgctgggagctgtagactagagctgttcctatttggccatcttggaacctctccgaaatttattttattaaagggactccagtgaaattcatattaaattttacagta

SEQ ID NO: 494 - DNA, 5225 bp, Homo sapiens
acacagttgtaacttagaatatgcttataatatttttaaaaatgttatagcatccttttaaagagtttatgaataatttgtgctggttttcaaggggaatgcttccagcttttgctcattcagtatgatattggctgtgggtttgtcacaaataggtcttattattttgagatatgtctcatcaatacctagtttattgagaatttttagcatgaagagatgttgaattttatcgaaagacttttctgcatctattgagataatcatgtggtttttctcactggttctgtttatgtgatggattacatttattgatttgcatatgttgaacgggccttgcatcccagggatgaagccaacttgatcatggtggataagctttttgatgtgctgctggattcggtttgccagtcttttattgaggattttgcattgatgttcctcagtgataatgacctgaaattttctttttttgttgtgtctctgccagattttggtatcaggatgatgctggcctcataaaatgagttacggaggattccctcttttctatcatttggaatagtttcagaaggaatggtaccagatcctctttgtacctctagtagaattcggctatgaatccctctggtccttttcttggttgctaggctattaattattgcctcaatttcagagcctgttattggtctattcaggaattcaacttcttcctggtttagtcttgggagggtgtatgtgtccaggaatttatccatttcttctagattttctagtttatttgcgtagaggtgtttataacactctctgacggtagtttggatttctgtgggatcagtgctgatctcccttttatcattttttattgtgtctatttgattcttctctcttttcttctttattagtcaggctagtggtctatctattttgttgatcttttccaaaacaccagctcctggattcattgattttttttgaagggttttttgtgtctcttgtcgccttcagttctgctctgatcttagttatttcttgtcttctgctagcttttgaatttgtttgccattgcttctctagttcttctaattgtgatgttagggtgtcgattttagatctttcccccttcctcctgtgggcatttggtgaaacactgctttagctgtgtcccagagattctggtatattgtgtctttgttctctttggtttcaaagaactaatttatttctgccttaattgtgttatttacccagtagtcattcaggagcaggttgttcagtttccatgtagttgtgcggtttgtagttagtttctcaatgctgacttctaatttgattccactgtggtctgaggggctgtttgttatgatttccattcttttgagtttgctgaggagtgttttacttccaattatgtggtcaattttagaataagtgcgatgtggtgctgagaagaatgtatattctgttgatttggggtggagagttctgtagatgtctattaggtccgcttggtccagagctgagttcaactcttgaatatccctttttttttttctgaatatcctttttaattttcagtctcgttgatctaatattgacagtgaggtgttaaagtctcccactgttattgtgtggaaatctaagtctctttgtaggtctctaagaacttgctttacgaatctgggtgctcctgtattgggtgcatatatatttaggacagttagctcttcttgctgcattgatccctttatcattatgtaatgccttgtttttttttttatctttgttggtttaaaatctgttttatcagtgatgaaaattgcaactcctgcttttttttttctttccatttgcttggtaaatcatcctccatccctttatttcaaacttatgtgtgtcttgcatgtgagatgggtctcctgaatacagcacactgataggtcttgcctctttatccaatttgccagtctgtgtcttttaattggggcatttagcctgtttacatttaagattaatattgttatgtgtgaattgatcctgtcattacgatgttagctggttattttgcccattagttgacgcagtttcttcatagcatcaatggtctttataatttggtatgcttttgtagtggttggtactggttgttcctttccatatttagtgctttcttcaggagctcttgtaaggcaggcctggtggtgacaaaatctctcagcatttgcttgtctgtaaaggattttctccttcgcttttgaagcttagtttggctagatatgaaattctgggttgaaaattattttctttattaatgaatataggcccccactctcttctggcttgcagggtgtctgagagagatccgctggtaagactaacagggatgggcttccctttgtgggtaacccgacctctctggctgcccttaatatattttccttcatttcagccttggtaaatctgacgattacatgtcttggggttgctcttctcggggagcatgtttgtggtgatctctgtatttcctgaattggaatgctggcctgtcttgataggttggggaagttctcctaggtaatatcctgaagagttttttccaatttggtccattctccctgtcactttcaggtacatcaatcaaacgtaggttcactcttttcacatagtcccatatttcttggaggctttgctcattcccttttgttttttttttttctctaatcttgtcttcttgctttatttcattaagttgatcttcaatctctgatatcctttcttctgattcatcgattcggctattgatactcatgtatgtgtcacgaagttctggtgctgtttttttcagctccatcaggtcatttatgttcttctctaaactggttattgtagttagcaattcctctaccctttatccaaggttattagcttccttgcattgagttagaacatgctcctttagcttggaggagtttgttattacctaccttctgaagcctacttctgtcaattcaccaaactcattctctatccagttttgttcccttgctgtcaaggagttgtgatcctttggaggaaaagaggcattctggtttttggaactttccgcatttttgcactgggttttcctcatcttcatggatttatctacctttggtctttgatgttggtgacctttggatggggtctctgagtggaagtcctttttgttggtgttgatgctattcctgtttgttagttttccttctaacagtcaggcccctctgctgctggtctgctggagttggctggaggtccactccagaccctgtttgcctgggtatcaccagcggaggctgcagaacagcaaagattgctgcctgttccttactctggaagcttcgtcccagaggggcattgccagatgccagcagagctctcctatatgaggtgtctgtcaacccctgctgggaggtgtctcccagtcaggaggcacggggttcagggaccaacttaaggaggtagtctgtcccttagcagagcttgagtgctgtgctgggagatccactgctctcttcagagccggcaggcaagaatatttaagtttgctgaagctgtgcccacagctgccccttccccaaggtcaaaaatttaaaattttaagtgactacttgaaaaataaaatatctaaatgatcagatccttattatcttcctctaagtcatctttggagatatctaacatctgtgatctgtgtaatgatttttaattctagcttataaatgacaagccaagacctttgccagtattttctttcaacttgatatttttgtcagacctctggaattatacatcatgtatctgatttaaagatttaattatcatagtttattcacctatcataattaatcatgcttagttaaaaagtctcatttcacagctacaaaaagcaaatactcatattcaaatttcactgtgcagaaacaagctaatcttttattagaaatatggctcccttccaaaaaggaaacagctttaattactaagaaactatgaagcaaatcatttggaccaacaatgactttgtttcaatgttctctcacataagccttactttattctttaaaagatgaatttagtcattagtagtacaacagggatacctgtttatgtaattaataaactaagcagatagtcccaagattaaatgttaccctgctacaatttttaacaaaagtgacggattctttcctaatatttgcctgccatttaacataaagtcataaagattttctgctcgagatgttttatgaagcacaaaacgacctcctttttaaaccaaagcaagattggctaatcaaattttttataactgcgaaacattacataacagggactgtgctttttatgtatcctttagctaacaaactgttactaaattttattacctcaaagacaactgaacacagaatggactactgcctttttgcctacacttcttacctaaaactaagcccttttgttctccaatacattaacagttcatttcaatttctggtatttgaaacgtaggtgtgatctaaagtctttgcacgtaattttaaaacaaaagcacttctgatagtttctaaacataaatgaggcaacacttcacttcttctttagttaccgctgtggcaggtcctcacctattcctgatttcaaagagtaaaactcattttctagaggagactgactctgtaaaaggttgataaatagagtatttataaatcacatgacaaaaaatgctataaactaggtacttataggttcaattatatattttttttaatttttaaacttttaggttcacgggtaacgtgaatgtttgttacacaagtaaactcatgagaacaaagttacaacacatcagaatctctgggacacagctaaggcagtgttaagagggaaattcgtagcactaaatgcctccatcaaaaagttagaaagatctcaaattaacaacttaacatcacaactgaaagaattagagcagcaataacaaatcaaccccaaactagcagaagacaagaaataaccaaaatcagagctgaactgaaggaaatcaagatatgaaaaaccattcgaaaggtcactagatccaggagttgtttttttgaaaaacttaatgagatagataggccactagctagactaactgaattatattttaaatgcactagaggagctgactttctaagaaatattat

SEQ ID NO: 495 - DNA, 8363 bp, Homo sapiens
tatgaagcaaatcatttggaccaacaatgactttgtttcaatgttctctcacataagccttactttattctttaaaagatgaatttagtcattagtagtacaacagggatacctgtttatgtaattaataaactaagcagatagtcccaagattaaatgttaccctgctacaatttttaacaaaagtgacggattctttcctaatatttgcctgccatttaacataaagtcataaagattttctgctcgagatgttttatgaagcacaaaacgacctcctttttaaaccaaagcaagattggctaatcaaattttttataactgcgaaacattacataacagggactgtgctttttatgtatcctttagctaacaaactgttactaaattttattacctcaaagacaactgaacacagaatggactactgcctttttgcctacacttcttacctaaaactaagcccttttgttctccaatacattaacagttcatttcaatttctggtatttgaaacgtaggtgtgatctaaagtctttgcacgtaattttaaaacaaaagcacttctgatagtttctaaacataaatgaggcaacacttcacttcttctttagttaccgctgtggcaggtcctcacctattcctgatttcaaagagtaaaactcattttctagaggagactgactctgtaaaaggttgataaatagagtatttataaatcacatgacaaaaaatgctataaactaggtacttataggttcaattatatattttttttaatttttaaacttttaggttcacgggtaacgtgaatgtttgttacacaagtaaactcatgagaacaaagttacaacacatcagaatctctgggacacagctaaggcagtgttaagagggaaattcgtagcactaaatgcctccatcaaaaagttagaaagatctcaaattaacaacttaacatcacaactgaaagaattagagcagcaataacaaatcaaccccaaactagcagaagacaagaaataaccaaaatcagagctgaactgaaggaaatcaagatatgaaaaaccattcgaaaggtcactagatccaggagttgtttttttgaaaaacttaatgagatagataggccactagctagactaactgaattatattttaaatgcactagaggagctgactttctaagaaatattatcattaactctttaatatacctgttttttaaaattcatacatttctaatagacagcagaaaataactaattagtatactgacagttgaaccttttttaatatttataattaaaaaatgaagtttattttatttttttaatatacttaaagttctagagtacatgtgcacaacgtacaggtttgttacatatgtatacatgtgccatgttggtgtgctgcacctgttaacttgtcatttatattaggtatatctcctgatgctatccctccaccctcctcctaccccatgacaggccctggtgtgtgatgttccctaccctgtttccaagtttttcattgttcaattcccacttatgagcacgaacatgcagtgttcggttatctgtccttgcgatagtttgctgagaacgatggtttccagcttcatccatgtccctacaaaggacatgaactcatcctattttatggctgcatagtattacatggtgtatatgtgccaaattttcttcacccagtctattgctgatggacatttgggctagttccatgaatatagcagcatgatttataatcctttgggtatatacccagtaatggaatggctgggtaaaatggtatttctagttctagatccttaaggaatcaccacactgtctgccacaatggttgaactagtttacagttccaccaacagtgtaaaaatgttcctatttctccacatcctctccagcacctgttgtttcctgacattttaatgttgccattctgactggtgtgagatggtttctcattgtcgttttgatttgcatttctccgatgatgagcattctttcatgtgtctgttggctgcataaatgtcttcttttgagaagtgtctgctcatatccttcgcccactttttgatggagttgtttttttcttgcaaaatttctttaagttctttatagattctggatattagccctttgtcagatgcgtagattgcaaaaattttctcccattctgtaggttgcctgttcactctgatggtagtttcttttgctatgcagaagctctttagtttaattagatcccatttgtctattttggcttttgttgccattgcttttggtattttagtcatgaagtccttgcccatgcctatgtcctgaatggtattgcctaggttttcttcttgggtttttatggttttaggtctaacatttaagtctttaatccatcttgaattaatttttgtgtaaggtgtaaggaagggatccagtttcagctttctacatatggctagccagttttcccagtaccatttactaaatacggaatgctttccccatttcttctttttgtcaggtttgtcaaagatcagatggttgtagatgtgtggtattatttctgagggctctgttctgttccattggtctatatctctgttttggtaccagtaccatgctgttttggttactgtagccttgtagtacagtttgaagtcaggtagcgtgatgcctccagctttgttctttggcttaggattgtcttggcaatgcaggctcttttttatttccatttgaactttaaagtagttttttccaattctgtgaagaaagtcattggtagcttgatgaaggtggcattgaatctataaattaccttggccagtatggccattttcatgatattgattcttcctatccacaagcatggaatgttcttccatttgtttgtgtcctcttttatttccttgagcagtggtttgcagttctccttgaagacgtccttcacatcccttgtaagttggattcctaggtattttattctctttgaagcaattgtgaatgggagttcactcatgatttagctgtttgtctgttattggtgtataggaatgcttgtgacttctgcacattgattttttgtatcctgcgactttgctgaagttgcttatcagcttaaggagattttgggctgagacgatggggttttctaaatatacaatcatgtcatctgcaaacagggacaatttgacttcctcttttcctaactgaataccctttctttctttctcctgcctgattaccctggccagaacttccaacactgttgaataggagtggtgagagagggcatccctgtcttgtgccagttttcaaagggaatgcttccagtttttgcccattcagtatgatattggctgtgggtctgtcataaatagctcttattattgcgagatacgtcccatcaatacctaatttactgagagtttttagcatgaagggctgttgaattttgtcaatggccttttctgcatctattgagataatcatgtggtttttgtctttggttctgtttatatgatgggttacgtttattgatctgtgcatgttgaaccagccttgcatcccagggatgaagcccacttgatcatggtggataagctttttcatgtgctgctggattcagtttgccagtattttattgaggatttttgcactgatgttcatcagggatatggtctaaaattctctttttttgttgtctctctgccaggctttggtatcaggatgatgctggcctcataaaatgagttagggaggattccctctttttctattgactggaatagtttcagaaggaatggtactagctcctcttcgtacctctggtagaattcagctgtgaatccatctggtcctggactttttttggttggtaggctaataattattgcctcaatttcagagcctgttattgatctattcagaaattgaacttcttcctggtttagtcttcggagggtgtatgtgtccagaaatttatccatttcttctagattttctagtttatttgcatagaggagtttatagtattgtctgatagtagtttgtatttctgtgggatcggtgttgatatcccctttatcattttttattgcatctatttgattcttctctcttttcttctttattagtcttgctagtggtgtatctattttgttgatcttttcaaaaaaccagctcctggattcaccaattttttttaagggtttttgtgtctgtacctccttcatttctgctctgttcttagttatttcttgccttctgctagcttttgaatgtgtttactcttgcttttctacttcttttaactgtgatgttagggtgtcaattttagatctttcctgctttctcctgtgggcatttagtgctataaatttccctttacacactgctttaaatgtgtcccagaaattctggtatattgtgtctttgttctcactggtttcaaagagcatctttatttctgccttcatttcgttacgtacccagtagtcattcaggagcaggttgttcagtttccatgtagttgagctgttctgagtgagtttcttaatcctgagttccagtttgattgcactgtggtttgagacacagtttatcataacttctgttctttttcatttgctgaggagtgctttaattccaactatgtggtcaattttggaataagtgtgatgtggtgctgagaagaatgtacattctgttgatttggggtggagagttctgtagatgcctattaggtccacttggtgcagagctgagttcaagtcctggatatccttgttaactttctgtctcactgatctgtctaatgttgacagtggggtgttaaagtctcccattattattgtgtggagtccaagtctctttgtaggtctctaaggacttgctttatgaatctgggtgctcctgtactgggtgcatatatatttaggatagttagctcttcttcttgaactgatccctttaccattatgtaatggccttgtctctttagatctttgttggtttaaagtctgttttatcggagagaggattgcaacccctgcctttttttgttttccatttgcttggttgatcttcctccatccctttattttgagcctatgtatgtctctgcacgtgagatgagtctcctgaatatagcacactgatgggtcttgactctttatccaacttcccagtctgtatcttttaattggagcatttagaccatttacatttaaggttaatattgttatgtgtgaattcaatcctgtcatcatgatgttagctggttattttgctcgttagttgatacagtttcttcctagcatcaatggtctttacaagttggcatgtttttgcagtggctggtaccgcttgttcctttccatgtttagtgattccttcaggagctcttgtaaggcaggcctgatggtgacaaatctctcagcatttgcttgtctgtaaaagattttatttctccttcacttatgaaacttagtttggcaggatatgaaattctgggttgaaaattcttttctttaagaatgttgagcctggctgccccgtctgggaagtgaggagcgcctctgcccgggcgccccgtctgggaagtgaggagcgcctctgcccagctgtccagtctgggaagtggggagcgcctctgcccaggcgccccgtctgggaagtgaggagcgcctctgcccagctgtcccgtctgggaagtgaggagcgcctctgcccggctgccccgtctgggatgtgaggagcgcctctgcccagccgccaccccgtctgggaagtgaggatcgcctctgcctggccgcctcgtctgggaagtgaggagcgcctctgcctggccgctgtgcaatcttccaagcatgaagtgacagcctgtctgcaggggtacccaacagctctgaagagacagcgaccatcgagaacgggccatgatgactatggcagttttgtcaaaaagaaaagggggaaatgtggggaaaagaaagagagatcagattgttactgtgtctgtgtagaaagaagtagacatagcagactccattttgttctgtactaagaaaaatttttctgccttgggatgctgttaatctataaccttacccccaaccacgtgctctctgaaacatgtgctgtgtcaactcagggttaaatggattaagggcggtgcaagatgtgctttgttaaacagatgcttgaaggcagcatgctggtcaagagtcaccaccactccctaatctcaagtacccagggacacagacactgcggaaggccacagggacctctgcctaggaaaaccagagacctttgttcaagtgtttatctgctgaccttctctccactattatcctatgaccctgccacatccccctctccgagaaacacccaagaatgatcaataaatacttcaaaaaaaaaaaaaaaagcaaatcataaaaaaaaaagaatgttgaatattggcccccactctcttctggcttatagagtttctgccgagagatccgctgttagtctgacgggcttccctttgcgtgtaacgggacctttctctctggctgcccttaatattttttctgtcatttcaactttggtgaatccgacaattatgtgccttggagttgctcttctcaaggagtatctttgtggcgttctctgtatttcctgaatttgaatgttggcctgccttgctaggttggggaagttctcctggataatatcctgaagagcgttttccaacttggttccattctccccgtcactttcaggtacaacaatcaaatgtagatttggtcttttcacatagtcccgtatttcttggaggctttgtttgtttctttttattcttttttctctaaacttctcttctcgcttcatttcattcatttgatcttcaatcactgataccctttcttccacttgatcaaatcagctactgaagcttgtgcatatgtcatgtagttcttgtgccatgattttcagctccatcaggtcatttaaggtcttctctatactgtttattctagttagccattcgtctaatctttcttcaaggtttttagcttctttgtgatgggttcgaacatcctcctttagcttggagaagtttgttattaccaatcttctgaagccttcttctctcaactcgtcaaagtcattctccgtccagctttgttccgttgctgacaaggagctgtgttcctctgcaggagaagaggtgctctgatttttagaattttcagcttttctgctctgttttttccccatctttgtggttttatctatctttggtctttgatgatggtgacgtacagatggggttttggtgtggatgtcctttctgtttgttagttttccttctaacagtcaggaccctcagctgcaggtctgctggagtttgctggaggtccactccagaccctgtttgcctgggtatcaccagcggaggctgcagaagagcaaatgttacagaacagcaaatgttgctgcctgatccttcctctggaagcttcgtctcaagaggggcacccggctgtatgaggtgtcagttggcccctactgggaagtgtctcccagttaggctactcgggggttggggacccacttgaggaggctgtctgtctgttctcagatctcaaactctgtaacgggagaaccagtactctcttcaaagctgtcagacagggacgtttaagtctacagaggtttctgctgccttttgttcagctatgccctgcccccagaagtggagtctacagaggcaggcaggcctccttcagctgtggtgggttccacccagttcgagcttcccggccgctttgattacctactcaagcctcagcaatggcggacacccctcccccagcctcgctgccaccttgcagttcgatctcagactgctgtgctagcagtgagcgaggctctataggcgtgggaccctccaagccaggcgtgggatataatctcctagtgtattgtttgctaagaccattggaaaagcacagtattagggtggaagtgtcccaattttccaggtaccatgtgtcacggcttcccttggcttggaaaaggaattccctgacctcttacgcttcctgggtgaggcgatgccccgccctgcttctgctcacagtccgtgggctgcacccactgtccgacaagccccagtgagatgaacccggtacctcagctggaaatgcaaaaatcacccgtcttctgcgtcgctcatgctgggagctgtagactagagctgttcctatttggccatcttggaacctctccgaaatttattttattaaagggactccagtgaaattcatattaaattttacagta

SEQ ID NO: 496 - DNA, 7166 bp, Homo sapiens
tcattaactctttaatatacctgttttttaaaattcatacatttctaatagacagcagaaaataactaattagtatactgacagttgaaccttttttaatatttataattaaaaaatgaagtttattttatttttttaatatacttaaagttctagagtacatgtgcacaacgtacaggtttgttacatatgtatacatgtgccatgttggtgtgctgcacctgttaacttgtcatttatattaggtatatctcctgatgctatccctccaccctcctcctaccccatgacaggccctggtgtgtgatgttccctaccctgtttccaagtttttcattgttcaattcccacttatgagcacgaacatgcagtgttcggttatctgtccttgcgatagtttgctgagaacgatggtttccagcttcatccatgtccctacaaaggacatgaactcatcctattttatggctgcatagtattacatggtgtatatgtgccaaattttcttcacccagtctattgctgatggacatttgggctagttccatgaatatagcagcatgatttataatcctttgggtatatacccagtaatggaatggctgggtaaaatggtatttctagttctagatccttaaggaatcaccacactgtctgccacaatggttgaactagtttacagttccaccaacagtgtaaaaatgttcctatttctccacatcctctccagcacctgttgtttcctgacattttaatgttgccattctgactggtgtgagatggtttctcattgtcgttttgatttgcatttctccgatgatgagcattctttcatgtgtctgttggctgcataaatgtcttcttttgagaagtgtctgctcatatccttcgcccactttttgatggagttgtttttttcttgcaaaatttctttaagttctttatagattctggatattagccctttgtcagatgcgtagattgcaaaaattttctcccattctgtaggttgcctgttcactctgatggtagtttcttttgctatgcagaagctctttagtttaattagatcccatttgtctattttggcttttgttgccattgcttttggtattttagtcatgaagtccttgcccatgcctatgtcctgaatggtattgcctaggttttcttcttgggtttttatggttttaggtctaacatttaagtctttaatccatcttgaattaatttttgtgtaaggtgtaaggaagggatccagtttcagctttctacatatggctagccagttttcccagtaccatttactaaatacggaatgctttccccatttcttctttttgtcaggtttgtcaaagatcagatggttgtagatgtgtggtattatttctgagggctctgttctgttccattggtctatatctctgttttggtaccagtaccatgctgttttggttactgtagccttgtagtacagtttgaagtcaggtagcgtgatgcctccagctttgttctttggcttaggattgtcttggcaatgcaggctcttttttatttccatttgaactttaaagtagttttttccaattctgtgaagaaagtcattggtagcttgatgaaggtggcattgaatctataaattaccttggccagtatggccattttcatgatattgattcttcctatccacaagcatggaatgttcttccatttgtttgtgtcctcttttatttccttgagcagtggtttgcagttctccttgaagacgtccttcacatcccttgtaagttggattcctaggtattttattctctttgaagcaattgtgaatgggagttcactcatgatttagctgtttgtctgttattggtgtataggaatgcttgtgacttctgcacattgattttttgtatcctgcgactttgctgaagttgcttatcagcttaaggagattttgggctgagacgatggggttttctaaatatacaatcatgtcatctgcaaacagggacaatttgacttcctcttttcctaactgaataccctttctttctttctcctgcctgattaccctggccagaacttccaacactgttgaataggagtggtgagagagggcatccctgtcttgtgccagttttcaaagggaatgcttccagtttttgcccattcagtatgatattggctgtgggtctgtcataaatagctcttattattgcgagatacgtcccatcaatacctaatttactgagagtttttagcatgaagggctgttgaattttgtcaatggccttttctgcatctattgagataatcatgtggtttttgtctttggttctgtttatatgatgggttacgtttattgatctgtgcatgttgaaccagccttgcatcccagggatgaagcccacttgatcatggtggataagctttttcatgtgctgctggattcagtttgccagtattttattgaggatttttgcactgatgttcatcagggatatggtctaaaattctctttttttgttgtctctctgccaggctttggtatcaggatgatgctggcctcataaaatgagttagggaggattccctctttttctattgactggaatagtttcagaaggaatggtactagctcctcttcgtacctctggtagaattcagctgtgaatccatctggtcctggactttttttggttggtaggctaataattattgcctcaatttcagagcctgttattgatctattcagaaattgaacttcttcctggtttagtcttcggagggtgtatgtgtccagaaatttatccatttcttctagattttctagtttatttgcatagaggagtttatagtattgtctgatagtagtttgtatttctgtgggatcggtgttgatatcccctttatcattttttattgcatctatttgattcttctctcttttcttctttattagtcttgctagtggtgtatctattttgttgatcttttcaaaaaaccagctcctggattcaccaattttttttaagggtttttgtgtctgtacctccttcatttctgctctgttcttagttatttcttgccttctgctagcttttgaatgtgtttactcttgcttttctacttcttttaactgtgatgttagggtgtcaattttagatctttcctgctttctcctgtgggcatttagtgctataaatttccctttacacactgctttaaatgtgtcccagaaattctggtatattgtgtctttgttctcactggtttcaaagagcatctttatttctgccttcatttcgttacgtacccagtagtcattcaggagcaggttgttcagtttccatgtagttgagctgttctgagtgagtttcttaatcctgagttccagtttgattgcactgtggtttgagacacagtttatcataacttctgttctttttcatttgctgaggagtgctttaattccaactatgtggtcaattttggaataagtgtgatgtggtgctgagaagaatgtacattctgttgatttggggtggagagttctgtagatgcctattaggtccacttggtgcagagctgagttcaagtcctggatatccttgttaactttctgtctcactgatctgtctaatgttgacagtggggtgttaaagtctcccattattattgtgtggagtccaagtctctttgtaggtctctaaggacttgctttatgaatctgggtgctcctgtactgggtgcatatatatttaggatagttagctcttcttcttgaactgatccctttaccattatgtaatggccttgtctctttagatctttgttggtttaaagtctgttttatcggagagaggattgcaacccctgcctttttttgttttccatttgcttggttgatcttcctccatccctttattttgagcctatgtatgtctctgcacgtgagatgagtctcctgaatatagcacactgatgggtcttgactctttatccaacttcccagtctgtatcttttaattggagcatttagaccatttacatttaaggttaatattgttatgtgtgaattcaatcctgtcatcatgatgttagctggttattttgctcgttagttgatacagtttcttcctagcatcaatggtctttacaagttggcatgtttttgcagtggctggtaccgcttgttcctttccatgtttagtgattccttcaggagctcttgtaaggcaggcctgatggtgacaaatctctcagcatttgcttgtctgtaaaagattttatttctccttcacttatgaaacttagtttggcaggatatgaaattctgggttgaaaattcttttctttaagaatgttgagcctggctgccccgtctgggaagtgaggagcgcctctgcccgggcgccccgtctgggaagtgaggagcgcctctgcccagctgtccagtctgggaagtggggagcgcctctgcccaggcgccccgtctgggaagtgaggagcgcctctgcccagctgtcccgtctgggaagtgaggagcgcctctgcccggctgccccgtctgggatgtgaggagcgcctctgcccagccgccaccccgtctgggaagtgaggatcgcctctgcctggccgcctcgtctgggaagtgaggagcgcctctgcctggccgctgtgcaatcttccaagcatgaagtgacagcctgtctgcaggggtacccaacagctctgaagagacagcgaccatcgagaacgggccatgatgactatggcagttttgtcaaaaagaaaagggggaaatgtggggaaaagaaagagagatcagattgttactgtgtctgtgtagaaagaagtagacatagcagactccattttgttctgtactaagaaaaatttttctgccttgggatgctgttaatctataaccttacccccaaccacgtgctctctgaaacatgtgctgtgtcaactcagggttaaatggattaagggcggtgcaagatgtgctttgttaaacagatgcttgaaggcagcatgctggtcaagagtcaccaccactccctaatctcaagtacccagggacacagacactgcggaaggccacagggacctctgcctaggaaaaccagagacctttgttcaagtgtttatctgctgaccttctctccactattatcctatgaccctgccacatccccctctccgagaaacacccaagaatgatcaataaatacttcaaaaaaaaaaaaaaaagcaaatcataaaaaaaaaagaatgttgaatattggcccccactctcttctggcttatagagtttctgccgagagatccgctgttagtctgacgggcttccctttgcgtgtaacgggacctttctctctggctgcccttaatattttttctgtcatttcaactttggtgaatccgacaattatgtgccttggagttgctcttctcaaggagtatctttgtggcgttctctgtatttcctgaatttgaatgttggcctgccttgctaggttggggaagttctcctggataatatcctgaagagcgttttccaacttggttccattctccccgtcactttcaggtacaacaatcaaatgtagatttggtcttttcacatagtcccgtatttcttggaggctttgtttgtttctttttattcttttttctctaaacttctcttctcgcttcatttcattcatttgatcttcaatcactgataccctttcttccacttgatcaaatcagctactgaagcttgtgcatatgtcatgtagttcttgtgccatgattttcagctccatcaggtcatttaaggtcttctctatactgtttattctagttagccattcgtctaatctttcttcaaggtttttagcttctttgtgatgggttcgaacatcctcctttagcttggagaagtttgttattaccaatcttctgaagccttcttctctcaactcgtcaaagtcattctccgtccagctttgttccgttgctgacaaggagctgtgttcctctgcaggagaagaggtgctctgatttttagaattttcagcttttctgctctgttttttccccatctttgtggttttatctatctttggtctttgatgatggtgacgtacagatggggttttggtgtggatgtcctttctgtttgttagttttccttctaacagtcaggaccctcagctgcaggtctgctggagtttgctggaggtccactccagaccctgtttgcctgggtatcaccagcggaggctgcagaagagcaaatgttacagaacagcaaatgttgctgcctgatccttcctctggaagcttcgtctcaagaggggcacccggctgtatgaggtgtcagttggcccctactgggaagtgtctcccagttaggctactcgggggttggggacccacttgaggaggctgtctgtctgttctcagatctcaaactctgtaacgggagaaccagtactctcttcaaagctgtcagacagggacgtttaagtctacagaggtttctgctgccttttgttcagctatgccctgcccccagaagtggagtctacagaggcaggcaggcctccttcagctgtggtgggttccacccagttcgagcttcccggccgctttgattacctactcaagcctcagcaatggcggacacccctcccccagcctcgctgccaccttgcagttcgatctcagactgctgtgctagcagtgagcgaggctctataggcgtgggaccctccaagccaggcgtgggatataatctcctagtgtattgtttgctaagaccattggaaaagcacagtattagggtggaagtgtcccaattttccaggtaccatgtgtcacggcttcccttggcttggaaaaggaattccctgacctcttacgcttcctgggtgaggcgatgccccgccctgcttctgctcacagtccgtgggctgcacccactgtccgacaagccccagtgagatgaacccggtacctcagctggaaatgcaaaaatcacccgtcttctgcgtcgctcatgctgggagctgtagactagagctgttcctatttggccatcttggaacctctccgaaatttattttattaaagggactccagtgaaattcatattaaattttacagta

SEQ ID NO: 497 - DNA, 11271 bp, Homo sapiens
gtgactttgagagaattccagggaattggtcagtccctgtttcacttgtaaatacacagcaatcaagcctaccaaatctatgattgattggggtgtctgaaagagatggagggaatggaatcaacctgaaaaacatatttcaggagttcatccctgaaaacttccccaacctagctagaggggccaacattcaaattcaggaaatgcagagaaccccagtaagatactccacaaaaagatcttccccaagacatcatcatcagattctccaaagttgaaatgtaagaaaaaatgctaaaggcaactagagtgaaaggcccggtcacctaaaaagggaagcacagacttacagtggacctctcactggtaaccctacaagccagaagagattgaggaccaatattcaacattcttaaacaaaaagaattccaacccagaattttatatctgactaaactaagcttcataagcaaaagagaaataagatcattttcagacaagcaaatgctaagggaatttgtgaccattagaccttccttgcaacagttcctaaaggaagcactaaatatggaaagaccattaccagacactacaaaacacactgaagtacacagaccagtgacattgtaaagcaactacataacaagtctgcaaaataaccagccaacatcatgatgacggtatcaaatcgacacatagcaacactaaccttaaatgtaaatggactaaatgatcccattaaaagacataaagtggcaggctggataaagaaccaagaaccattggtatactgtcttcaagagacccatctcctatgcagtgacacacataggttcaagataaagggatggggaaaaatctaccaagcaaatagaaaacagaataaaacaggggttgcaatcctagttgccgtcaaaacagactttaaaccaacaaaggttaaaagaaaaaaatatgggcattgcataaggataaagtgttaaattaaacaagaagatctaactatcctaagtatatatgcaccaaacacaggaacacccagattcataaagcaagtttatggagaccttcaaacagacttagactcccacacaatagtagtgggagactttaataccccatgacaatattagacagatcattgagacaggaaattaacaaagatattcaagatctaactcagcactaaatcaaatggccctgatagatatctacaggactgtcctacttgaaaccatacaattacatggtaattgaatgacctgctcctgaatgacttttgggtaaataataaaattaaggcagaaatcaagaagttttttgaactaatgagaacaaagatacaacataccagaatctttgggacacagctaaggcagtgttaagagggaaatttatagcactaaatcccacatcaaaaagttagaaagagctcacgttaacaatctaacctcacaactacaggaactagagaactgagagcagaaaaacctgaaagctagcagaagacaagaaataaccaaaattagagctgaactgaaggagattgagacatgaaaaaccattcaaaagatcagtgaattcaggagctgttttttttttgaacaaattaataaaatagaccattagctagagtaataaacaagaaaatagaaaagattcaaataaacacaatcagaaacgacaagggggatattaccactgaccccacagaagtacaaacaaccatcagagaatattatgaacatctctatgcacataaactagaaaatctagaagaagtggataaacttctggacatatacacccttctaagactgtaccaggaagaaattgaatccctgaacagaccaataatgagccctaaaattgaggaagtaatacatagactaccaaccataaaaaaacccagtactagatggattcacaggtaagttctaccagttgtacaaagaagagctggtacagttcctactgaaattattccaaaaagttgagtaggagggagtccttcctaactcatttgatgaggccagcatcatcctgatatcaaaacctggcagatatacaacaagaaaagcttcaggccaatatccttgatgaacttcaatgcaaaaatcctcaataaaatactggcaaactgaatccagcagcacaccaaaaagcttatccaccatgatcaagtagaatgcaagttggttcaacatatacaaatcaataaatgtgactcatcacataaacagaactaaagacaaaaactacatgattatctcaacagatgcagaaaaggctttcaataaaattagacatccatttatgttaaaaactctcaataaactaggtattgaaggaacatacctcaaaataataagagccatgtatgacaaacccacagctaagatcatactgaatgggcaaaagctggaagcattttctttgaagactggcataagacaaggatgatctctctcaccactcctattcaacatagtattggaagtcttggccagggcaatcgggcaagagaaataaataaagcgcatccaaataggaagagaggaagtcaaactatccttgtttgcagattacatgacattatatctagaaaaccccatagtctcagccccaaagcttcttaagctgataaacaacttcagcaaagtctcaggatacaaaataaatgtgcaaaaattactggcatttccatgcaccaacaacagtcaagccaggagccaaaccaggaatgcactcccactcacaatcgccacaaaaagagtaaaatacctaggaaaacagctaattagggaggtgaaagatctctacaaggagaataatgaaccagcgctcaaagaaattagagatgacacaaacaaatggaaaaacattccatgttcattgataggaagaatcaatatcattaaaatggccatattgcccagagcaatttatagattcaatgctatacctattaaactactgttgagattcttcacagaaccagagaaaactattttaaaattcatatagaacccagaaaagagcctgaattgctaaggcaatcctaagcaaaaagcataaagctgaaggcatcatgctacctgacttcaaactatactacaaggctacagtaaccaaaacagcatactactggtacaaaaacagacacatagaccaatggaacagaatagagaacccggaaataagaccacacacctacaactatctaatctttgacaaacctgacaaaaacatgcaatggggaaaagatttcctattcaataaaaagtgctgggataaccggctagctgtacacagaagattaaagctggaccccttccttacaacatatacaaaaatcggccgggcttggtggctcacgcttgtaatcccagcactttggaaggccgaggagggcggatcatgaggtcaggagatcgagaacacggtgaaaccccgtctctactaaaaatacaaaaaattagccgggtgtggtggcaggcgcctgtagtcccagctacttggagaggctgaggcaggagaatggtgtgaacccgggagacagagcttgcactgagccgagaccacatcactgcactccagcctgggcgacagagtgagactccgtctcaaaaaaaaaaaaaaaaaaaagaagacatacaggtagtcaacaagcatatgaaaaaaagctcaatattactaatcatcagagaaatgcaaatcaaaaaccacaatgagataccatctaataccagtcagaatgatattattaaaaagtcaaaaaataagatgctggtgaggtagtggagagaaaggaatgcttatacactgttggtgggagtgtaaattagttcaaccattgtggaagacagtgtggcaattcctcaaagacctaaagatagaaataccattccacccagcaattccattactgggtacatacccgaaaaatagaaatcattcttttataaagatacatgcatgtgtatgttcattgcagcactattcacaatagcaaaaacatggaatcaacctaaatacccaccaatgatagcctggataaagaaaatgtggtacatatacaccatggaatactatgcagccataaaaagaacgagatcatgtcctttgcaggaacatgaatggagctgaaggccattatccttagcaaagtattgccgaaaaagaaaatcaaatactacatgttctcacttataaatgggagctaaatgatgagaacacatggccacacagggggaacaacacacactggggcctattggagggtggaaggtgggaggagggagaggatcaggaaaaataattaatagatattatttcatcacccaggtattaataatacctatttcatcacccaggcttgatacctgggtgacaacaaacccccatgacacaaatttacctatataacaaacctgcccgtgtacccctgaacttaaaataaaagttaaaaaaatgcaaaaagatgacataccaaagagatgttacttttcatttttaaaaaagtcaaagaatttaaggaaaattaaaaagaaatcaagaatgacagtagcagctccaaaatatttagaaggtagagttgaaaattttgattttcttagtgcagaaaaatattttgtgctgcatgtttttttaaagaaagtcattttatctgtatatgtgattaaaaccttatttccagtgccatcttcgtgtaattgttaagaacttggattgtggatcacaggaacctggctttgactcttaactgctcactctttaaatggataacccgggtaagttatttcctgtctctgtgcctcagttttcttacaaattggcatgaaaataacagtgcctccttcagagggtaattctgaggattaaatgaaatattgcccatacagtgcttaccacaggctggtagatgattggtattcggtaaacagtagttatttttgttatactaatatgttattaatataattaccattttgtatttttaaatgtaagccataaggaaaggaattattccaatagtttaatttacaaacttgagttttctagaaagacttttaaaaacagtagtgatataaatcaatttatcttaagaaacataagtatctgggccaggcaagtttcagaaatgtttatcattttcaaagtaccaaatattctcgtcaaaacaagctgcttcatcagagttctaattatatatttaaacatacatgcacacacacacgtttgtattacaatattcaaaacttctgaggaagaattatcttttttttttcatgtgccaaagctaaaactttcacttgctacagctgtgtattagtctatttccatactgctataaagagctgcccaagactgggtgatttataaaggaaagaggtttaattgactcacagttcagcatggcagggaaggcctcaggaaacttacaatcatggtggaagtcaaagggggagcaaggacctttcttcacaaggcagcagaaagaagtgccaaatgaacagggaagagctccttatgaaaccatcaggtcttgtgagaactcacttacttttatgagaacagcatggaggaaactgtccccatgatccaatcacctccacctggtctctcccttgacacgtggggattatggggattaaattccagatgagatttgggtggggacaaaaagcctaacgacatcaagctgtaaaaacaatagctaacattcattgactgtttcccagcattaggataaatgtgtgtaacaagaggcattttatttatgtatgacatttgtttatttattatttatttatttggataaatgtctataacaagaaacattttatttaagtataacagcaaatctacaagttaggtactatcatcactcccattttacaggtcgtgaaactgaggctctgaaaagtcaagtcagttttctaatgttgtccagctaatgactggtagatttagtatttgaacccacatttgcctgattccaaagttcaaactcccaacaacatgtggtaaccaaagcaggaacagaagagaaagaagaaatagaagggagggaagatgaacaaagtagacaaagtttagttaatagaattagtggatacccaagaaaaaactatgtacaagagggggaaaaaaaccctgttttctcacatctgggaaacattgatatctatatatttttggttttaaataaaaattaggttatgtcattcatttgcataaaaccatccaaagaagggcctcacaaaattaaaacaaaatccaaactctctactatgggccacaccctccagaacttcagctcgtactatgtttttcctcacacctctcaacataccaacatgtttccacctgcagccctcaccactagttattctttcaatctggaaatattttcgctaagatcttcctatggttaccttcttatcattcaagacttaggttatgtcaggccttccctgactcctccatctgaagtaacccctcctgcttactcctgtttattctctagactccacagaggattcatcactctctgaaatgatcccattaatttcttcttcacttgtttcctctccacgacctgtaagccccaagtggacccggacttggtctgctctgcttacagctggattccagttcccatagtgctagacactaggattaagccaggaaacatgggtgaagcagcaagcacagagcttggggcacagcctagcaaacactccacaaaggaccatgattgtaactgtagtagggcacaccaatgaacaggttgggaaactgagtctctgagaagagactaatgttgtgctggatgaaatttctttttctgacaatacattatccaaatcctccaagctttcagtttaaaggggaaagcaggaactatcattataattttatttacaaagtgtccatgtatgaacattattcaccgccgaatcatctcttcctatgcaagcaacaccgtcctatgcatcaatatcctgatctgtcaggattcaggataaagtggacatatacacactaattgcaaagggaaattgtacatcttgcaaaagatgcaggggtttatagagtcttgtaacattggtgagctgctcagatcacacacatgaccgtggttggacaaggatctggcaaagttaacacagatcaccgaagaaggaaaagtggacaacacaacacagtaagttcttcaaaagagttatattagaatatcaaaagattatgttaggcctttgggaaaactcaaaactttatgaagacctcaaaaaattatgcaaaaatgacccttcaatggtcatgctgcaagagtcaaatgacacttcaaacaactgcggctttctatgttgtgcaaatgcatttgttgttttaaaggtcgtaaagtcagggtacacgtggcagatacttatgacttggaggaagacgttagattagatttgaaactttcactgaatgatcgcatttcatgcttttcatctgtacattaaaaagccagaatgtctttgccaagaaattctagcataaataaaagaaaaggatgggattttggaacatcatggtagaattcttgactatcagctttatacaacatgtctggacatttagtgatggaaatgctggattccaaaggaatgtaggcaaaggtactactacccccatgctcttcagaaaacatcctctaaaagcaacagtgatgatcagatactgtggggcaagactgacagtgacactcaagatttccactcttctctttaatcatatatttcctgtcattcatgtgctacaaaactctggaatatgcaaagctcattcaaatgcaaaaccagcctttgctccaacatgagcatatattttcatttaaagacaaatcagatgtttcatttgattttttttataaatctgataataatgtacatttaacccgtgtttacaaccaaaataattaatctctctgaaccctttgtttttcctgtctctatcctccaccctcattgccagataaataacatctgcaacctgatgtggcatattgaactttgtttatactcacacaaacacgtataagcatcccagatacacatatacagggactgtatctgtccttgttgtttttatagaaattggatcacattagacatattttctgatgacttttgtacattatagttggtcttcacagtcaatagctccaaagctatcttatcttctaaaatagctgcataatattcctcagtatggatataccaaaagatatttaaaccattgcctaatcaatgaatatcctggtagtttccacattgttttttccatttccactatagtggaataaactttcgtgttcaaaaatcctaaactggtgctatatttctatagaatagaggcacagatgtagaagtgttaccctcaaatcaatatgcatttagttttgaaaaacagacactgccatattattttcttaaaaaggctctacagattcacatttccagcagcaatgagtgtctcaagcaccttttaagtggtaagcagcttaccaggggaggtggcctattattctatcagtggcttcagttgttaggacaccacgggtcagctgtggagatacggttgtggggcaggttgagttcaggacacatagaagattgccaaagggtgactattattactttgagactctggaaaaattagccaggaaacagagacaagaggctcagggtgcagcaaagcagccaaatcaggatgatagtgttttctttggagcagatatactaatggccaaggaactcataaaaagatgcctaatgtcatctcattagggaagtgcagtcaaagccacagcatgatacgtcttcacacccacgaggatggccataatcagagagacaataaccagtggtagggaagatgtgaaaaaatcggaatgctcatgcattgctggtaggaatgtgacatggtgcagctgctttggaaagcagtttaacagttcctggaaaagttaaacatggagttaccctaagacccagcaattccattcctaggtaagcaagaaaatgaaaacatatggccacacaaaaacttgtacacaaatgtccatagcagcattttcataatagctgaaaagtggaaacaacccaaatatccatcaattggaaaaaggaaatctagcatttgcatataatagagtattaatcagccataagaagaaacaaagcaccgatccatgttatatcatgctttatacttggaagcatggtactaagtgaaagacgccagacacaaaaagcaaaatattgtatgattccatttatataaagtgtctagaataggcaaatccatagaggcagaaaacagattagtggttgccagtggctgggaatagggaaaaaactcagcgctaaagggtagggagttttgttttggagtaatgacgatgttctggaattagacgtggaacgattgcacacatggtgcaaatatccttaaaatcacggaattgtcactctaaaaggtgaattttatggtaggtgaattgtacctcaatttgtaaaaagaagaattagataaataaacagcaacacagcaccaaggggtgggggtaggaaacagacaacaaataggagtgaagagttcacaggaaaagacatgcagccagcttttaagcagaagaaaagatgtttggcctcataaatagtaaaataaaagcacaataaaattatgacacttggctttcccttgccaaattggttaaaaaggagacaattgatgaccccagtggaaagcgtataaaaaaagagcagctgtggctgggtacggtggcttaacgcctgtaatcctagcactttgggaggccgaggtgggcaaatcatgaggtaaggagttcaagaccagcctggccaacatggtgaaacactgtctctgctaaaaaacaaaacaaaacaaaacaccaaaaaatagctgggcgtagtggcgggcgcctgtaatctcagctacttgggaggcggtggcaggagaatcatttgaacctgggaggcagaggttgcagtgagccgagattgtgccactgcactctaacctgggcaacagagttcagagtgagactctgtctcccccaaaaaaaaaaaaaaaaaaaaaagaacagccatatagatcgtcggtgggagtgtaatttggccacttctttggaaaatagctcagtaatatctattaatacttaaaatttcacaaacactgtaagtctaacttccacttctaaaatgttatcctagaaataaaattgcataggggtacaaaggcttacgtatggaactatttgctggactactgtagttgtggcaaaaaactggaaatgacctaaacgcttattagtagaaacctggttaaataaattatcatatgtccttgaggacacagggacacaaagaggggaatgacaggcactgagcctacttgagggtgggaggaggaagtcgatcagaaaaaataactagtgggtactaggcttagtacccgggtgaaaaaataatctgtacaacaaacccccatgacatgagtttaccttataacaaacctgcacatgtaatctgaacctagataaaagtttaaaaaaataaataatcatatgtccctacaatgaaatattccacaggcattaaaattccccaaggaattttagtaaggaaagaaaaagctgtgcccaacagcacgtacagtatgtttccatttgtttttaaaaaatggtgtcgggaggttgaggagacaacttataaatagacatgcctgggatacctctggatataagaaactgtaaagtatttacttctaaggaaggaaatttgggatggggcttggggagccatcagagttagggtggggattttttctctgccttatcttattatgtatatcgctcagaatgtttgctatgtgtatgcacctaccccatccattaagaaatgaagaaataatgaaaagaaaaaatgaaagtagggaactagaaatgagaggtgggattcaaagtggactgaacacttgacctatttcccaatttgcctagggctggcccagcagcgaggcaggttctaaccaatgagcatcagctttgaatggaggggctgataggccaggtgggccctgcttgctgagagtgtcatggccttagggacatctccatgttgcagagtctgagcctctgcttggcaaattcagaaaatccagcttttctttttatatcacctggagctgatg

SEQ ID NO: 498 - DNA, 8843 bp, Homo sapiens
tgaaaaactttaaaaggacgggtaattgtctaacattttgttaattcaatcaggcttgcaatttaaaaatagctttgccttttactgaaaaagaaattaattataatttcttactgaatccagggagagaattcgggactagggggttccctgagaaggtcttcttacacgttaccctccaatgtcctgtggccaagggagcttcaaccccctctttacgagggttctggtggctggagaactcagagacggctctaaaaaaattgcaagctggccaggcacggtggctcacccccgtattcccagcactttaggaggctgaggcaggcagatcacctgaggtcaggagtttgagaccatcctggccaacacggtgaatccccgtctctactaaaaatacaaaaattagctggacgtggtggcgcacgcctgtaatcccagctactcagggggctgaggcaggagaatcacttgaacttgggaggtggaggtcgcagtgagccaagatggtgccattgcaccccagcctgggcgacagagcaagacttcatctcaaaaaaataaaaaaatgtaaacatcgcaagctgcacccaggtgtgaatctggagggcgcctccttggaaaacttggctggtgaccgcaccctcagttcaagctcaccggccgcccttccctgtgcacacacgtgagctctccagtatgtttggaatatcccagagccgctgtctcctggctgcccggcctctgtgagccgcactccagcctgaaggccaagacggctgctctggagaaagaacttcccctggtgctgaagtcccgaaggagagccccatgggcatggggaggggagggtgcctcgcccccaaggctgcgctgctccgcggcctggccgggaccaccacacagaggcttctctaggaaacaagccacactcagtgtggcagcagtgaagtgcttttctcagcttcctgctttcctccagagagtaaaccagtgcctgaccgtccggttctccctgaatcaacactcaccgaaaggagctggtggaggggcccgtgggcgacaaacagccacaaaccagaccccggggtctccggagctgggggctctgggtggcccaggggtcgttaatgggcacggtttccagtccagtccaggccagctgtggtggggctcagacccgtccagacactgggagccagtcacccccagaataacgagctgggcctcgagttccaagtcatctttgagcagccgtgtgtcagcaccgctgtccctgaccaccccgtgccggtctgcctccgtctcctccttctcgctgtaccccaggtcgggagctaaagggcaattcagagcctgctgcctgcaggcaaaacgtctccccagcaccgcaagtctgcgcaatttgaggcccagaaaccccctggacgtagcttctgcttttcaaaaactgttcattcgtttagccccaggggacctcatccctgtatgtccacactgggcatcccaaggaagctgggggggaaccgcacctgcatccctccaactcagaaacccccttctgcaccggcagctccgggcccgcactaagtgtgcagcgtggccatcctgcggctgagacacagggtgtccggcagcgtttggatggattctacaatatttgggacagacttacactaaaaaatcagtcactgcttctccaaacttcctgttgagctgggcaccctgtgtttttgtttgctgcgtttttgtttgttgtatctgggtaccctaagaatgatcccaaattacaaagtcaggccctgcagactcatgggaggcagaatgggggcccctaaacatgcccacctcccggtgcacggaaactgtggacacatgaggctgccagtcagccgcctgacacggaggggtgaccctggattatccggggggacccagtagaatctcgggcccttcaacatagaggcggagggcagagcaggtctcagtgacgagacaccactggctctgaagacggaggatgggactgagggccgaggggttctcccctggagcctctagaaggaaccagccctcccaagacctgatgttagcccagggagaccatttcagacgtctaacctgcagaaatggaaagtgtaagtgttcttttttaaaaaattgtcatgagtacatacagggtgttgctatttatggggtccatgagatattttgatacaggcatccaatgtgtaataatcacaacaggggaaacggggtgaagccgctatgtttgtgataattttttagagcagccataaaaatatatgtaaataggacctagttagataacatatatttttggcttctgctctgtagaaactcacacatgatttggggagttgtgaaggcctgatttgattttgtttgtttgtttgcttgcttgcttgcttttgagcctggtgtgccgggcgggcaggtgtttcattgaacctggccccttgcttgttcaagtgttgagtgagggcagtctccaggttccgggagcttccgagtgagcctcacgcctcacggctgcaggtcagaaagtgatttgtggcccagagacccccggacgtagcttctgcttttcagaatctgttcattcatttagccccaggggacctcatccctgaatgtccacaccgggcatcagacctggttgcagagtgggtggttccaggaggcagcagtgtagaccagtgaaggagcagccagggcctgagtgaagctggggcagcagaagcagctttcgatattttttttctgctgagtcttgccagcttttagtttagaagttccttcctggggaagaaagtggccgcttaaatggcataaaaaataatgcaccaggcaggggacccttgagaccctggggctgggctctggctgggggcctcacacggaggaggagggatgagactctcaaggaggccaaggtcccaggtcctgggctatcggaggctccttggggcctctgccttccccaggagcaagcaaggaaggaatgtacagcagcagggcgtgggcacagggcagccccaggaacaatggggatagtcacgtggccccagcctccacctcgctggcactcctcttgtcccaggacaagcccagcctgctgcccgctgcctgcttctcctgcattggagggctccaggcccagaatagctgctcggagccagcatttgcatccacgtctcctccacacgttagaaaacctggactttgttttgtaactgctggttccgctcagcaaatagaattgtacctaactgtggaggggccctacacagtggcccggcccgggagacccacgagggcctcaggagcatggcttctcccgtctgcctcctggtttctgtctctgaccatgtatctccaagccagtcagtcctgagtggccacagtggggatggggctgcaccaggggcctgccctgctgtgctggcctctgccagggctgggccctgcctgtgaaggagccctgggttgggctcttttgtgcccactctcaggtggggttgcgggaggcctgcttggccccatggggatcagtgtgatgagcatgactggaggatgtgcgggcttaggatgagcagagggaccctacagagccacgaccccaggcccagggcccctgttggccccaaagcgagtgtggtggccgtcgttgggaccccaacagggggtggcactggcgtgaggtctgacacttgccaaattcctgcgagctgacccctcgatggggcttgcactctaattctgccccagggaagcccaaggtcaggattagcatcccccctgcttaagggacagctgaggccagggtggggctggggtggaatggcgggctgcatgcaggaagcccatggagcccagatctgctccaggtcacaaccctgtacctggcttggggtccacactccccagacacagatggtggcatgttcccctcggactgtccacctgttgttcggccaagccctgaccctcacagcaggctgctgagttcaaggatgcccctgggcagccaggctgggacccttgcccactccctggacgcacatccgcccgccgctgggttcacaggggagggattagaaacctctcaacggaacgtcgacgaggcgagtggggtggggatgggggtgggaaggggacaggccctcccccacacgtggggagatgcatggctgtgaggtgctgcctccgcctctgaggctggcgataggctggattcagacacagctcgagccgctcaccctccacgtcctgcttaggaggagtgcggggccggctaaatccccaatgcccagggcccaggggcatcccatccatagcctcaaggtccctggcttcccctggggatggggctgtcgcacctgtgtcctcccagttccgaggtaccattgatacacacacaggggtccctgggggagtttcctaactcctcttcctctgaaggccaggcctgggagaatgaattctccaagcacccaccctcactgtaccacggcaggttagagaatgcggacagagctgcttggctgcacaccttgggggggcgtcaccctctttttagcctcagtttccccatctgtgcagtgggtaccagagaggactttacacagaggctgtgcattcccttttttttaattttttttttttgagtcagagtctcgctctgtcgcccaagttggagtgcagtggcgcgatctcggctcactacaacctccgcctcctgggttccagcgattctcctgcctcagcctcctgagtagctgggattacaggcgcacatcaccatgcccggctaattttttgtatttttagtagagacagggtttccccatgttggccaggctggtctcgaactcctgacttcatgatccacctgccttggcctcccagagtgctgggattacaggcatgagcgaccgtgccctgactgaggctgtgcattccctaacagagggggacgtctggctgcccccacaaaacagcagctctgagcatgtctaaggtcagcccctccctgctttccttttctccctgatcaaattcatgtggcttccactcagccccttcttccggctcttacttaggaatgcagatctaccccaaaccccaacacacactggaaccctcaaggtcccatcctactgaaagccaggtagccggtgcagtgagcaatggacagatggatggatgatggatggtggatggatgatgggtagatggaggaatgcatgatggatgaatgaatgaatagattaatggatgaattgagtagatagatgaattgatggatggatgatggatggataaatgaatggatgatggatgaatagattaatagatgaatgaatgagtggatggatggatagatgggtgaatgcatggatggatcatggatgatggatggatgacagatgcatggaaggatagatgaatgaaagaatgggtgaatggattaatagatgaatgaatgagtgggtggatggatagatgggtgaatgcatggatggaacatggatgatggatggatgacagatgcatggaaggatagatgaatgaaagaatgggtgaatggattaatagatgaatgaatgagtgggtggatggatagatgggtgaatgcatggatggatcatggatgatggatggatgacagatgcatggaaggatagatgaatgaatgaatgggtgaatgaattaatggatggatgaatggatgacaggctctccatgagccgctctgctctcctccatggcctcctgctcactggcccctatatctcacatcctacttccagtttaatggagacaagagtgtcctccccaacccaagttctcacccccatcccttcctccctcagacccacctggaagagctgcttctcttctcttgtagaagtctcccatcccaaggaggtgcctggtctttcccctcaggaaggcacctggtccttcttcctcccttccctcctgggagacatctggcccttcacctccccctgccccttcacctcctatcaaggcagctccctcagtattttctgcagaccttgtttgtctcctgtgacgttcataccctcccgttcccacagacattcttccatgtccagcccagacagaaggaggtccccccctgccggatggatgattgaggctgcctgtgtgtacacgtatgactgagcaatggacggaggtgtctgtgtgcagcaggcatgtggcacgacctcggaagagggaacaagacaagatgtcccccaaggtgcccatgaggaccctccctgggcagctggactccagcccaccttgggctgcagtgtgcattgggggtggggccaaagacccctccacatagagaaggcagccaaagggaggagggagtggtcagaaaaggttgtctcagccagggagcggctccaccctctcctgaggacgcctgacctcagacgtcagctcccgttagagacccccgtataccccctgcctagagccaaactctgagagtctctggatggactgaggggtgggacaaggaaaaaaaggaaggagggagggagagaagcagcaaggaggggtcgcctggcccggctcccccagtgaggaaaggggctgtggcacagagattccatctgcagggctgggggcagccgagaatggcacctccaacgcccacggcaggggcccacccgcctgcctcctccgggaccaccgggcctggctcctctcacagactctttgagagcgtatttgtgaaacgtagcatattgtgggtgattagatttaaatttcaatacactttgttaaaaatagagttggctctcgccaagaggaggccgcaggaaggggctctcaacggctcgtctttggaatattaatagtatggaaatgttattagaataatttttcatcatgaataataaattaatggaataattcggcagcgccacgtgacataccctgctaagaggggctttgttttaacagaatggggagggtgggtttggggtgtgggggagggcagagctgggggagggtccgcccagggcaggcggggttgggtggaagtgagtgaggtgcctgaagagatgaaggctccggaggcatttggggaggaggacagagacctgggaccaagtcctcaggcacttttagcttcatgtctcagccagggttctggccctggccggctccttcccacagaaaagctgggaagagatcttggtaggtgtccggccccacacaccatcctgctgggggtggctgggttggacttcaccatccccacagccctgcagcctcccctcctgcatctttctccttggtaaatgccaggaacctcaaaagcacccagaggcccagagaaattgagcacacaggggtggggaattcaagagcaggagctgtttctagggccccaggggcagggccagggtctcctggtcatttctgtgctcgggacccctgctgcacctgagctcactgtggaaactgcctgagggggccacacggagctgatggggacaagcatgcagggtgggcacccttgtgggctcagcttggtccagggtgtccactgggggacggggagggagatggagcaccagggaagaagcgtctcttcatgtggtcagcgccccctccttctccccactccctccttttgcctcccttcctgctgctgcctgcacggtgagaacagagatgagatggcccctgcccgggagcagtcagcggcaccacaaccctcccaggccaacccagctcctgacagagagggagggaggcagcctggggctgggggccctggcagcagtggcacacggagtgtgcacatggatcctagtcagccttttgcagggcgctgaagccagtgggggcccccagggaggttttgggggagtgttgagggggcctgaagggttccgctcctcccacccagggaaccgccatgccactagtgggctgtcctggagactcggggagaaagcacacaggctgtcgggaaaggtgggtcgcaggcgggcagggcagccctgctgtactgatgggcaggcgctgggtgggtggaaggcaaagccatcaggtcatccccctctctgtccctgcattgggccaaccaggtgtgtcaggaggatatttgaccattcctgagaggcacattctctctctctctctctctctccctctctctctctccctctctctctccctctctccctctctctccctctctctccctctctctccctctccctctctctctccctctccctctctcccccctccctctccctccctctccccctctccctctccctctctccccctccctctctctccctctctctccctctctctccccctctctctccctcctctctctgtcacacacatttgcacatcctgcagtgtgaatggagtatgaatgtgtgtggtaggcgacagctgtgtgtgtacgtccgggtgcgtgtgtgcgtgtgtacatgtgagcgtgtgtgcacgtgagttagagcctgagtgtcccctgcgtgggttagtgtgtgcgcccgcccggtgccctccgtcttgggagtctgggctgctgctccgcgggctctggagccggcgctccccacgagcccggactctccgccgcgcccgggagctgcgcaatcggctgctaagacgccggcgccaccggctgggccctgttctcccctctcttttctacagtcttacccgcagctgacagggttcgaaagagcatgaaacggaggagacgttacagcaacgtgtcagctgaaatgatgggcgtagacgcacgtcag
